United States Patent 8,343,764 (GENES ENCODING GLUTAMINE SYNTHETASE AND USES FOR PLANT IMPROVEMENT) - sequence listing, part 3

SEQ ID NO: 9660 - protein, 496 aa, Botryotinia fuckeliana
AQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTALHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASL

SEQ ID NO: 9661 - protein, 501 aa, Botryotinia fuckeliana
AQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNGARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPR

SEQ ID NO: 9662 - protein, 258 aa, Helianthus annuus
MANYGGDKQYARETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKCDAKVKESLPGGHRQEDHYQSQTTTTTTGGGPGYGETHEKKGMMEKIKEKLPGHH

SEQ ID NO: 9663 - protein, 120 aa, Helianthus annuus
TNVHSTTEGYNVGGTGTTIGTGGYEEGKHGGAGGILHRSGSGSSSSSEDDGEGGRRKKKGLVEKIKEKLPGGDHGSDEHKTSATATTVGGGEYGYKEGEEGHEKKGLMDKIKEKLPGSHQ

SEQ ID NO: 9664 - protein, 331 aa, Beta vulgaris
MAELNNGGHSKELVVSFGEMLIDFVPTSSGVSLAEAPGFLKAPGGAPANVAIAVSRLGGNAAFVGKLGDDEFGHMLAGILKKNGVSADGLSFDKGARTALAFVTLKSDGEREFMFYRNPSADMLLTPDELNLDLIRSAKVFHYGSIRLIVEPCRSAHLKAMEEAKKAGALLSYDPNLRLPLWPSAEEAREQIMSIWDKAEVIKVSDNELEFLTGNSTIDDATAMSLWHPNLKLLLVTLGDQGCRYYTKNFKGSLDGFKVNAVDTTGAGDSFVGALLNKIVDDHSIIEDESRLKEVLKFANACGAITTTKKGAIPALPTVADALELIKKNAS

SEQ ID NO: 9665 - protein, 292 aa, Dianthus caryophyllus
MATSTATNHFLKTLAISITTQKPTSIFPPKSLVLEKPTTNNSQFHYKTHHLCCMCCLQTSDFEQESSPNAVIDEEENVEKTEAAVNWEDASEPQPSSGFGSEDGFSEPSEDVKLYVGNLPFDVDSEKLANMFDAAGVVEIAEVIYNRETDRSRGFGFVTMSTVEEADKAVEMFHSYELNGRLLTVNKAAPRGSRPEKAPREFCPLLSESYVGNLPWDVDNDRLEQLSSEHGKVLSARVVSDRETERSRGFGFVTMASETEMNDATLGALDGESLEGRPIRVNVAEERPRRTF

SEQ ID NO: 9666 - protein, 378 aa, Streptococcus pyogenes
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVELAIPAGTQTGKTFRLKGKGAPKLRGGGQGDQHVTVNIVTPTKLNDAQREALQAFAEASGEKMLHPKKKGFFDKVKDALEDI

SEQ ID NO: 9667 - protein, 295 aa, Agrobacterium rhizogenes
MTTSRLGGTFTLPGTSLQIKRMSYGTTQLPGPHVWGPPRDKDAALAVLREAIALGANHIDTAEFYGPHVSNQLIREALAPYPSDLALVTKIGFERGEDGSWFPDRTPETLRRAVHENLSSLGLEALDVVNLRLGGPHGPDENSVAEPLGVLVELQRKGLVRHIGLSTVSPAQFAEAEKMAPIVCVQNEYNLVRRGDDAFIDELAAKGVAYVPYFPLGGFTPLQSSLLSSVADELGASPKQVALAWLLQRSPNILVIAGTSSVDHLRQNFAAADLVLSPAQVATLDGIASGVASEG

SEQ ID NO: 9668 - protein, 352 aa, Agrobacterium rhizogenes
MGEISVKNISKSWADFKALNNINLDVREGEFLSILGPSGCGKSTLLRIIAGLESPTDGDIVIAGKQVTNDPVWKRKIGFVFQNFALWPHLTVFKNVAMGLELRKTPKDELQQRVTKALRMVQLEALADRLPSQLSGGQQQRVALARAIVLKPDVLLLDEPLSALDKNLRQDMQVELKALQRTLGLTTVFVTHDQEEALSLSDRVVVMNRGVIEQLDTPDNIYNKPVSEYVARFVGEAFFFKGEVTGSNELVLDGGNAVAVKSDVPAAAGKAVAFVRPEWVSLSKLESQLNPEALRGTVERLMFFGQSSDYIVRVGDEQMRVKRHSGDAALAEGDTVAINCIARLLPNEGRSQ

SEQ ID NO: 9669 - protein, 194 aa, Agrobacterium rhizogenes
MRLILMGPPGSGKGTQAKRICEKLGIPHLSTGDILRAEVKAGTPLGLAVAATMAAGGLVSDDTVSAIVASRIAGPEAQRGFVLDGFPRTISQAAALDQSLGEHSLTAVIELVVPEEELYDRICRRAAESAGAQRADDNAATLELRLKAYRAETLSVSEFYKGRSPYFQIDGLAAPEEVTARILELLESAAAEYS

SEQ ID NO: 9670 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 9671 - protein, 359 aa, Agrobacterium rhizogenes
MFVRSDALSRIKPSATIVVSQKFRELKAEGRDVVRLNIGEPDFDTPDNIKTAAIDAINRGETKYTPVSGIPELRKAIASKFKRENGLEYSWEQTIVGTGGKQILFNAFMATLNPGDEVVIPAPYWVSYPEMVALCGGTPVFVSATQEHDFKLQPADLEKAITPKTKWFIFNSPSNPTGAAYTHAELKALTNVLMQHPHVWVLTDDMYEHLTYSDFKFVTPVEVEPSLYDRTLTMNGVSKAYAMTGWRRLCRRPAPAHQGHGHDPGAADLGCDVDRPVGGCRSAERHPGLHPGEQEDLRRPPRPRRLHAEPGQGHRLPGAGRRLLRLSVLRRPDRQDGAVGQGHRDGRGFRFRASGIGRR

SEQ ID NO: 9672 - protein, 204 aa, Halobacterium sp. NRC-1
MTPDAYLDLVARIDADVPVVCMTYYNLLFQYGDRAGPAAFVSAAAEAGVSGFVVPDLPVDESGPLREACRAHGLDLVFVVAPTTTADRRERMLDLTTGFVYVQGRVGTTGAREEVSAATPDALAALQHTDIPKAVGFGVSSGEQAREITASGADGVIVGSAYVDTVADGVADDDPPSVVADRLRDLAAELKAGAARGVPEPEHK

SEQ ID NO: 9673 - protein, 227 aa, Halobacterium sp. NRC-1
MLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 9674 - protein, 242 aa, Arabidopsis thaliana
MVSMTTSSSSYGTFSTVFNSSRPNSSATFLVPSLKFSTGISNFANLSNGFSLKSPINPGFLFKSRPFTVQARAAAEKTVHDFTVKDIDGKDVALNKFKGKVMLIVNVASRCGLTSSNYSELSHLYEKYKTQGFEILAFPCNQFGFQEPGSNSEIKQFACTRFKAEFPIFDKVDVNGPSTAPIYEFLKSNAGGFLGGLIKWNFEKFLIDKKGKVVERYPPTTSPFQIEKDIQKLLAELKNFCS

SEQ ID NO: 9675 - protein, 281 aa, Arabidopsis thaliana
MAADNAYLMQFVDETSFYNRIVLSHLLPANLWEPLPHFLQTWLRNYLAGTLLYIISGFLWCFYIYYRKINVYLPKDAIPTIKAMRLQMFVAMKAMPWYTLLPTVSESMIERGWTKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWAANIHDCIHGNIWPVMGAGYHTIHHTTYKHNYGHYTIWMDWMFGSLRDPLLEEDDNKDSFKKAE

SEQ ID NO: 9676 - protein, 502 aa, Lotus corniculatus var. japonicus
MAALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 9677 - protein, 491 aa, Thermoplasma acidophilum
MNFLISVYDKTGLAEFLKKVRGHIDVVYATSGTYRSLKDLGLNLHETSEITGFDDLLGGRVKTLHPVLYAGLLYRDRNEGNQVKFDVVISNLYPFSVDMKTEDEMIENIDIGGVSLTRAAAKNYRNILVLTSPEDYATAADVINSGNIPEDYRKRMAMKAFIRMAEYDARINEGLSRISGLASDSYVAIGYNGEKLRYGENPDQAGYLFTSDPSVGVAASEKLNGKELSYNNILDADSAFETALEFDDPAVIVMKHNTPSGVAQDNDIVAAFRKAWDADPESAYGSVIAVNRKVTEDLAAAMKPYFIEVLLAPDYDEKALDLLRKKKNLRVLKVRWQRDDRLRIRSVSGGFLAQTPMRASIDASSLRLVTEKGADEKTVQDLLFAWKVVARSRSNSIVFAKDLVTTGIGAGQTSRVEAARIAAQRAGDRSRGSVMASDAFFPFPDSIDVAASAGIKAIIQPGGSIRDDEVIKRCNELGIPMYFTGKRVFLH

SEQ ID NO: 9678 - protein, 449 aa, Thermoplasma acidophilum
MMQEELNGIKIKVTPPGPEAKKIIDMNDRYLARSTQSLPVVGKIGRGVYVEDVDGNVYLDFSSGISVTNLGHVDPYVTAKVEDQLHKMWHFPGTDFYTEMQVLAAKSLIEVTPGKFEKRVFFTNSGTESVEAAIKVAKSYTGRGMFIGFIGAFHGRTQGSLSFTASKPIHHRGFFPSMPGVEHVPYPNPYRNPFGIDGYENPDELVNRVIDYIETYLLKTYVPPEDVAGILAEPVQGEGGYIVPPMNFFRELRKLADSYNIPLMMDEVQSGFGRTGKFFASEHFGVEPDVITLAKAIASGIPMGAVVMRKEMNFKESGLHSNTFGGNLIASAACVATIEEMKKLNVVENSAKQGAYLRKRLEELQSKYDAIGDVRGLGLMQAIDFVKDRRTKEPNSKLRNAVIDNAFRLGLILLSTGSSAIRIIPPLIITQDQIDEGIEVLDKAIKQSL

SEQ ID NO: 9679 - protein, 384 aa, Thermoplasma acidophilum
MVSHRYKGFNTKAVQSGELRDPRFGNVTTPIFETSTFVYPNPEKEAYTDHTRDQPYIYTRWGNPTVQAFEEKYAAVEGAEYALSFSSGMGAITSAITGLLHPGSRMLSLSDLYGQTFYFFNKVLGDLGIKVDYIDTERINSLDFDPSKYDAIYMESITNPTLKVPDIRSVSDYAKKSLVIVDATFASPYNQHPLDLGADVVIHSATKYIGGHSDIVMGVVGTNSKEIFNSLVIRRKTYGSNPDPIQAYLALRGLKTLGLRMEKHNRNGMEIATFLRKNDSISRVYYPDTEMGKKVLSGFGGMVSFEIRRDRDVHSFLRKLSIPMVAASLGGVESLITLPAETSHSSLSREERERMGISDNLVRFSIGIEDAEDLIADIQNALGA

SEQ ID NO: 9680 - protein, 233 aa, Thermoplasma acidophilum
MGLKESKKENLNLNSGWLTLSIILLWVGWFGFNPGSELAFTTETVIVVITTFLAAASAMVSTMLTKFLVSKQDPGLIYAVNGVLMGLIVITPLAGYVSPGSAIILGLISGPIFVSAESIFSKHKWYSDPIGVLPGHMVGGIFGLLMIAFFTQTPFADASGASNLPNGILFGGGIMALHQLGLEAMAVVVVGAFVFTVSYASVYAISLLLNGILRDSEYSPARPANRLAKDTGA

SEQ ID NO: 9681 - protein, 451 aa, Thermoplasma acidophilum
MEEYDVITIGAGGAAYPAAFRLKRSGFSVLMIDKKGVMSGNCLAEGCVPSKAVIETVHNLAKMRHFGDYSIDYSKIVDHKDSVQNIRYEQHDQELKEAGLKIIKGTARIIDDNTVEVSSDTGTSRYRSSSAIIIASGSETFVPKIPGAELAWTSADLYSLKPKVKKLPKSIAIIGGGYIGMETASFMSILGVKVTVIEMLDRVMSTMDEAMVDKLLPLLPKMDIRTASPVQSIERNGSMYHVNFGKEGEKESIEVEAVLMAVGRVPVFPEGIDDLGIEHDRHGIKVNMAMQTNIKNIYATGDVNGITPLFHAAKRQSLVAANNIMANNVPIDYFDPLSVPFTVYTIPQMAYVGILPSQARKMGIEYLETDYQIEKDALAQINNEMFGEIRIFTDKRMKVIGGYVIGNDAGNVINEIALAVSKGLSLRDLAEMAHQHPMTFEGIDSAARKLY

SEQ ID NO: 9682 - protein, 485 aa, Thermoplasma acidophilum
MYREKFTKITEGFTFDDVLLIPMRTAVEPKNVVVSSRISRHIQVKVPIVSSPMDTVTEDAMAIAMARYGAIGVIHRNQPREKEVEMVKRVKREETIIIRDVYTISPETPIEVARTLMATRNIAGLPVVKDDKLVGIVTKRDLEFVKKGSSVSDVMVRDVITAPENVDIDEAIEILHKNRIEKLPLVDSSGHLVGLITAKDIITRQKFPDASRDSEGQLMVGAAVGPFDLDRAVEVEKAGADFIVVDTAHADNENVLSSLKKMRKQISVDIVAGNIATAQAAEDLISCDVDGLRVGIGPGSICTTRIVAGVGVPQLTAISDVAEAAKDSGIPVIADGGIRYSGDIVKAIAAGADAVMLGSMLAGTEESPGQEMIINGRKYKAYRGMGSIGALTTGLSDRYSKLGNGFIAEGVEGAVPYRGRVDEVLFQLVGGLRTGMGYVGAATIEDLKRNGKFVRITNNGLRESHPHDIRLISEPPNYQISNISP

SEQ ID NO: 9683 - protein, 382 aa, Thermoplasma acidophilum
MQGYTDASEMIRSSIREFVRREIEPLRSKIDRDDYFPVDKFRMMGKMGYLGVTVPPEYGGSGAGYIAQAIIEDELGYSSPSLALSYGAHSNLCLDNIYRNGSKYIRETFVPKLASGDYIGSLCLTEPGSGSDALAMSTHIDEVDGELYLSGSKMFITNAPYADLFLVHSRDGDGYSSVIVLASDGGFNRGRSLEKMGMRGSPTGEIFFNRVRIEPGRIVGGRGSGKKIIMSGLNSERVILAFIFIGLARRAIDEAVNYASQRKQFGQHIADFELIQEKLSYMYVRYEASRMLAFRALEKLQFDMMDPIDAASAIMYASESAEYIAREAIQIFGGYGYIKDTGIEMLLRDAILGQIGAGTTEIRKRVIARSLVKMYEEGRRIE

SEQ ID NO: 9684 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 9685 - protein, 397 aa, Thermoplasma acidophilum
MRRRRITVWPRSVWEEARAIPLCLRGIDMNFEFDEAQKEFRKKVEEFARREFTEEAASKYDLQEKYPEEVVRRMISEGVFDYSNPWNILVATETFCKYDAGMGISMLVPFFGNEVIALFGNDDQKKKYLSKVFSGQAKMGLAVTEPGGGSDVANIKTTAVKEGDHYVLNGSKMFITNGDIADFFVLLARTSVEKKKHQGMSVFIVERNFDGFKSNKIHGKLGVRATDTAELTLENVKVPAENLVGEPGRGFYYIMTFFDISRAYVAAQALGIAEGILERAVGILQKDGPITSQPERVQFAIADMATRIEAAKLLTYEAASFIFNFNPNPAVTSMAKAYAAETAVYVSRKAMEITGIDGLSSNIERSFRDAKIMEIWEGTSEIEKLVIARMLKVGDSQ

SEQ ID NO: 9686 - protein, 445 aa, Thermoplasma acidophilum
MGFFDEMDNMRMRPFHRKMEILASMGMFLDGYDLSVIAMAILLMPIQLKFSKPEYILVNVSALAGMIVGAPLLGRLSDRIGRKKIFDIDLILFVVFAITAGLATNFWMMFISRFMLGVGIGGDYPISSTIVSEFAPVKRRGTLLYAMVGMYWLGSLFSGIMNYTFAFTYYFWRYTFIIGGIVAIPIISLRMQIPESPRWLVSQGRADEASKVIENITGKEPDLNEGVIEGKEERSVRFRDLFSSGFLSKTVFVLSVWFLFDVASYGIGFYYPTMMREIGLSASALNTAGLRVIAEIGMIVAVGAIVGYAVAMMLADRVGRRVLTLVGVFVMFALLFLGSMVKIVSLIPLVSFFFSFVLFEQWVGAATLFYPTELYPTNYRSTIQGIATSVSRVGAIMGVVVFPLYPIFHSMFLFATLMFVAFVITVLFAPETKKKPLEKIWNAKA

SEQ ID NO: 9687 - protein, 273 aa, Thermoplasma acidophilum
MKLIENWFSERYSDNLQLSFRVSDQLLSIKTDYQRIDLFDTYDFGKLLAIDGTVQLTERDEFIYHELITMVPYHLTPRPPENALIIGGGDGGAARRLIDLGLKHIVNVEIDDQVVEVSKRFFPSLSSAFNDSHVKLLIQDGIKYVKNTSEKFDLIIIDSTDPEGPAEGLFSKDFYNDTRKIMNEGAVIVSQSGSPFYQPKAIKLAYSGMREVFSDVRVYTGFIPTYPSGFWSFTVASPWTMKPRPVNMSGKYFNADVMEGSFRLPQFVKELIT

SEQ ID NO: 9688 - protein, 484 aa, Thermoplasma acidophilum
MLSFERVRIKKADPDERVKTFDIEPLDNYTDEEAIAEASRCLGCNMCSAACPASLDISGYIRSTAAGDPAQTVRIIMETLPFPAIIGRVCTHMCEDICVMYDGGGPIAIRHLKRYAADKFDDYGEILRPQKRKFIGKKVAVIGGGPAGLTVAYYLSLQGVKVTLFEERPALGGFMKTGIPRYRLPQSVLDKEIGYVVSRGVDVKLNTKVGRDISFDQIMKEYDAVFLGVGNHKPRMTGTPGSDAPNVMHATEFLERVSFGERIDVGDTVAVIGGGFTANDSARTSLRLGAKHVYIMYRRRDVDRPGYPSMNADEEMDEAEEEKVEYVWEVTPFEYVKENGRVVAMKYWMNEMVKEGKGRAKPVPIKDKVYTIKVDMVIEATGQETDYSFLGDYVKKLRLNPHGEPIVDQNGMTSIEGVFSGGDSTNPNRDLISAVRDGDIAVQGILKYLNVMDKVSYDDLPILDRFKPYSYTAAQEAYAVRGLI

SEQ ID NO: 9689 - protein, 346 aa, Thermoplasma acidophilum
MADMTDQLPEVRKSHPYVMYEMMKDIPNGIDRTLSSMQNADLSFIGDDLIFLGNGTAYHSAYVGSQILDRVSKRHAVVQAYEYLNYMQSNAATIAISHTGKTKSTVDAVIKARKTAKTAGITHYADSPLYNSVDYPIAIADEDKSLCNTKAFFNNAFASLYIADYYGNLSYDMKNLRSEIAKHVGKDDPEMRSAAEELDQIDDIFVLGSGFNFPVAREAAQKIKEATHIHAEGIEFEEFNHGCTAVMDENTLVILIEGEKDRARGDQIARASRYVGSKTLAINGVGDISVYNDPQDDLSAAFLNTLDLYYLAYYLAVRRNINPDMLRFEDRRYRDYDSVVFPPGEH

SEQ ID NO: 9690 - protein, 380 aa, Thermoplasma acidophilum
MVRLSKDLQFPIRDSFDRNAFSVNFPIYATTAYRSPEGDHFRYSRENNPTVEELARQISLLEGSQLAACFSSGMGSISTVFLSLLKPGDGLVLPMDVFGRTYLFAKDFLSRFGINVSITDPGTDKVIEAIGDKTRMIFVESLSNPVLRVYDIKRLSDSAKQNNALLVVDDTIITPVGQRAIDHGADIVVNSLSKFIGGHNAAIGGSSSGSSEFIKNIDSDRRSLGSSMDPFSAFLFLQGMKTLKIRIERSSRSAQIIAEHLSTLDHVERVYYPGLTENDYHDLALRTLKNYGSVVSFVLDDGVDASKFMSSLERIIPANTMGSVETLISNPYSMSHRNLSDKERARIGVVPGLMRLSVGIEEISDIMDDIENAIKKSLKS

SEQ ID NO: 9691 - protein, 299 aa, Thermoplasma acidophilum
MIGSNARSQIDDLIDSMHSIGIGNTPFIEVDDGIYAKIEWMNRFGSIKDRPAFFIIYSLKESGDLDGKTLIEASSGNTGLAVSGIAKMLGVRSIIVLPENASPFTKRSIMENGSRVIETPASLGTEGSINRLKEMVSTDDFIWLNQHSNTKNSDSHYYTTAREMVDSMGVPSAIVAGIGTGGTITGIARYFKEIDPGVRVIGVQPAAGSHIHGLRNVSASKYRGIIDRYGHLIDEIVYVNEDQAISEIRRYYEKSGQLIGISAGANLYASRLFHERYRKIFTVFPDSGEKYREEIGPLI

SEQ ID NO: 9692 - protein, 426 aa, Thermoplasma acidophilum
MQWQAMGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 9693 - protein, 474 aa, Thermoplasma acidophilum
MESNAYAKPVKVPGRSIITSLSAMGYFLDGYDLSVISVFTLVLVTYHIFRYTAFTESFVTGSALLGAFVGAVLFGHYADRIGRRYLYIFDLIFFAVFAVLTALATNIYEMIAFRFFVGLGVGADYSLSPVYTTEMYPNAKRGGGYGWVWTFWSLGAAAAFIIGYGFYLIDPLTGWRWTLGLGAIPAIVVVVMRMRMPESIRWKAADKNVSEQEIRDVADSIGIKKEEMDSIMAERNRESRIRSGSLSSLFKGEYGKRTLIVWIQWILYDIAGYGIGLYSPLILKELGVSGSYTLLYSFMFYMPIGFMGAFGAVMLNDRVGRRPLQILGFGSMALAILLFFFAASGKGQVFLAIGILAFIIDYALGNLGPGNTMGLYAIELLPTKLRSSSMGSATGITRIVSFLSAFLFPYLSKPTVLGKEGFFFVLFVVMILALIFTIFFTPETKGLSLEEITVAKYRHEGWKPVLALDDTSKK

SEQ ID NO: 9694 - protein, 493 aa, Thermoplasma acidophilum
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 9695 - protein, 435 aa, Thermoplasma acidophilum
MDIVVIGGGAAGMAAASKAKRVNKDANVTVIESGSFVSYAECGIPYFLQGIVGKAEDLLHYPLEEFTEKRGIKVITGRVVKKIDTASLSLVLDNGSAVKFDRLIIATGSRPRIPDGIASGVFGLRSLESAIRLKEAIDGSRTITIIGAGVLGVELASTLTEAGKRVKVISKYDRVMPQLDPDMGKILNDYFSSKVEVEFSSTPVEIKKGEDGFAVKTTVDDHVSDVVIAAVGIVPNSNIAVDAGIKVDQRGAIITDEHMETSIPGIYAAGDVATVKNIITGQDEMMPLAQIANKAGRVAGSNAAGSEMRFPGAIGSTLVKVFDMEVGFTGLNEKRASVLGIPYGKTMIKAKSRANYYPGKEDIFVKILYDSRDKKIIGGQVIGKDGAAWRLNTLATAIFAGFTVEDLFYDDLGYTPPFGPVWDPLVVAGSVSMRE

SEQ ID NO: 9696 - protein, 477 aa, Thermoplasma acidophilum
MSGNSDSKLKANSVGFMPLLGQAIAMISPLGAVAATMTGSASIALGSLPLAYLIAIFAVLFWINTPYQYSRKIASAGGFYTYNTEGAGPYYGSVSGYILFFSYYMTYTNAILFITGVFIPGLFSIFFGITLNAYIWIPTLIVFGLIILLPAYLGIEGSTKYSFASSIIQIMLLVILSIAIIIIKGPANTLAPFTPKPAGGFGPVFVGMILAIFSMSGSSAVVSLGEEAKQPKKNIRNALLISFLITGVVFVLTSYALTIGWGINNMSTFAESGTSLAYGNGVPGIIVALKYLGMPMAIAMMIFAVNSLYTGSLAPLNSAGRMLYAMARDGIAPKIFSRVHGKRKTPHIALIFIAVSGMAVSLIAGLIMGPFMGFLYLVTASAVALFIGHIMTDISLPIAFRKFREFSIAKHAILPGISIVLLLIGIYYSFFPPSYPTNIAIISAVVFMIVVTIALNIYLKRKGITENMIAETSPSTN

SEQ ID NO: 9697 - protein, 401 aa, Thermoplasma acidophilum [sequence omitted]

SEQ ID NO: 9698 - protein, 277 aa, Thermoplasma acidophilum
MHVQAKFSNNLNIFEYSIVIRKIFYLGPPGSFSQEAAEIFGSDLVPVRSISEIFHKISVTGDYGIVPIENSIEGPVNETLDGLFRHEDIYIVDHVEIPIEIFLASNCDTENIRRIYSHPHAIAEAGDYLERTENIEVIRTSSTSEAAKLASMDEAGAALCSMKAAQHYGLANTVKIESKSRNITRFILIGRERNVEGSRHIILCVIPDRPGSLHSLIGVLASRGINMNMIYSRPLRDTIWKYYFYIEFSGKLDEDLLLTMGKQSLRILYKGSFKCCR

SEQ ID NO: 9699 - protein, 230 aa, Thermoplasma acidophilum
MQEKIRRKSSQPVYLYGMKNMLRIGNKLYTRTSKNKKVYGEDIIRFEHANYREWRPDRSKLAAAILKGLHNMPIGESSSILYLGASTGTTVSHVSDIAPSGRIYAVEVAYEPFSKLLDLAEQRDNIYPILEDANLPERYRFFVDHVDVIYQDISQRNQIAIFKRNMDEFQPRSAFLVLKTRSIASTEDAKTILRKTIEQLSSYNIREVIDLSPYDTDHYLILVDAKGVRR

SEQ ID NO: 9700 - protein, 384 aa, Thermoplasma acidophilum
MGNFGVTQDEELVLSFVRKFAEEELKPLAKEIDEKMEVPRKIIDRMKDLGLFATYIPKEYGGYGMSFPFLVRAIEEISKACPSTALVLDGALTLFAEPLIMFGSEDLKKRYLPRVAAGSVGGLAITEPGAGSDAAGISATAVKKGDRYVINGDKIFISNGRISDFFVLDAVTDPGKRHRGITAFVADRDTPGLKISRDIHKMGIRGSSTVELAFEDMEIPAENIVGKENEGFKVIMETLDAGRIGIAAQALGIAENALAEAIDYVKQRKQFGTEIANFEGIQFMIAEMATEIEAARYLTYVAAEKWQNKENTIEISAMAKMKASDVAMRVTTDALQLFGGYGYTTDLDAERHMRDAKITQIYEGTNQIQRLVIAKEILKKTRYY

SEQ ID NO: 9701 - protein, 303 aa, Thermoplasma acidophilum
MGDHGDAKDHASELKDIFSLKKIADAKYSYEDSDYVIFGVPFDNTSSYRRGSKYAPDSIRSAYVNLESFEFSYRFDLLRARISDLGDMEESEDVEYVVDQVDRVTKMVFSDGKIPIMLGGEHSITVGAVRNFPEDVHMVIVDAHSDFRDSYMGNKLNHACVTKRALEILGPNRITSIGTRSVSLEEYQDPDFEKVEFIPSFSVREYGIERFINDIERRPGRVYISIDMDGIDPAYAPAVGTPEPFGLTDYEVRRLVERLSYKAIGMDINEFSPLYDNGNTSMLAGKLIQVFIASREKYRIEHI

SEQ ID NO: 9702 - protein, 408 aa, Thermoplasma acidophilum
MDEFFLMNSFDLAGKTVYLRVDINAPVNPLTGEIMGIDRFRAHIDTIRNLRNSKVVIVAHQSRPGKDDFISLRQHAQILSHLLNKRVQFVDQLFGSQVNRAVSEMSDGDIVMLENSRFYSEEVDLTTIESMESSNIVRSLSPLFDYFIIDAFAAIHRAQTTLVGFHRIKPNIAGTLIEREVSMIERFRKIREKPKIAILGGAKIEDSIAVSENFLSRGFVDKILTGGVVANAFLWASGFDIGKKNREFIMKNNGDYEKLLDKCRAILSKYGDKLVMPTDFVMNPSGQRISINEKIPDDQILADIGLDTIVEYSEIIDGARAIFMNGPMGMYEIEDYSSGTREVFTAVAHSKAFKLAGGGHTLSALDKLGLTKMIDHASTGGGALISYLSGETMPVLEALKESKKLFEG

SEQ ID NO: 9703 - protein, 365 aa, Thermoplasma acidophilum
MAKDYYKILGVDRNATDEEIKKAFRELAKKWHPDLHPENKQEAEEKFKEISEAYEVLSDPQKRRMYDQTGTVDFGAGGQNFNWDNFTHYSDLNDIFNDIFGGNFASDFFSGFGRGQREEQYDLDLYTNLDITLEDAYYGTEKRIKYRRNAMCPDCNGTGAKNGKLITCPTCNGTGQQRIVRGQGFFRMVTVTTCQTCGGRGRIPEEKCPRCNGTGTVVVNEDISVKIPKGATDNLRLRVQGKGQSYNGRTGDLYVVLRVRNDRNVQRINDDLMIDQKINFAQAALGDTIEVNLFREKYSLKIPEGTQPGEVLRIKGAGMPHLNGHGSGDLLVRVNVEVPKRLTQKQKDLIREIFDIKENHRSWFH

SEQ ID NO: 9704 - protein, 392 aa, Thermoplasma acidophilum
MNVFNTASDEDIKKGLASDVYFERTISAIGDKCNDLRVAMEATVSGPLDTWINFTGLDEVLKLLEGLDVDLYAIPEGTILFPRDANGLPVPFIRVEGRYCDFGMYETAILGFICQASGISTKASKVRLAAGDSPFFSFGIRRMHPAISPMIDRSAYIGGADGVSGILGAKLIDQDPVGTMPHALSIMLGDEEAWKLTLENTKNGQKSVLLIDTYMDEKFAAIKIAEMFDKVDYIRLDTPSSRRGNFEALIREVRWELALRGRSDIKIMVSGGLDENTVKKLREAGAEAFGVGTSISSAKPFDFAMDIVEVNGKPETKRGKMSGRKNVLRCTSCHRIEVVPANVQEKTCICGGSMQNLLVKYLSHGKRTSEYPRPKEIRSRSMKELEYFKDIS

SEQ ID NO: 9705 - protein, 229 aa, Thermoplasma acidophilum
MIFLDYDGTLVPIIMNPEESYADAGLLSLISDLKERFDTYIVTGRSPEEISRFLPLDINMICYHGACSKINGQIVYNNGSDRFLGVFDRIYEDTRSWVSDFPGLRIYRKNLAVLYHLGLMGADMKPKLRSRIEEIARIFGVETYYGKMIIELRVPGVNKGSAIRSVRGERPAIIAGDDATDEAAFEANDDALTIKVGEGETHAKFHVADYIEMRKILKFIEMLGVQKKQ

SEQ ID NO: 9706 - protein, 260 aa, Thermoplasma acidophilum
MMERIMWYGSGKRLFKNLDQDYIRIFKDLREGRIPELDGMGEIPDLRKLLIEYGKERIREEFTPDQALIKVAAVRNAMDEIINKYYEKCLPFSIPYGISQSGDPCQFFRNGLSFPDISAIFRKGTEMCDFRSQMDDAIRTRIKEIMPNTADLVGPKLAMDLLERSRGLRRLALMPASSIQMLGAEKALFQSLGQGKKNPKYGVIFKFPGLSALNPKARGRIARIIANKVAITARADLLGTHVDSRSMREDIEEKIRKVKK

SEQ ID NO: 9707 - protein, 211 aa, Thermoplasma acidophilum
MLVSPSIVAASPLKIQDQVRECENAGSVSFHLDVMDGNFVPNITVGPDYYEFLRSISRIRIESHLMVMRPDLYYRKFAKEGDLVLVHYESPVNTLALLKRMKDEGIDAGIVINPDTSFSKVSDLLEYAQILLIMSVYPGFSGQKFIDVSDKIHEASAFIKKNGLKTKIEVDGGINDNTARIVKNAGADIVVSASYIFGGNISERIRILSSI

SEQ ID NO: 9708 - protein, 483 aa, Thermoplasma acidophilum
MFPKGFKFGFSEAGFQFEMGISDPDPNTDWYVWTHDKYNIQNHVVSGDLPENGAGYWDLYHRDHDFAQHLGMNAARIGIEWSRIFPKSTEEVKVSVQNDRGDVLNVDITDRDLDKLDKIANKDAVNHYRSIFSDFKNRGNYLIINLYHWSTPVWINDPSKRDIEKDNAVGNCFTTRSIVEFAKFAAYVARAFDDLADRWSTMNEPNILFNGQCSNDWRPDSMAIRKKLFAEAHARAYDSIKKFSEKPVGIVYANGDMQPLTDEDREARDLAEYEIRYSFFDAITKGDLSWYANAAQNRSLDYSSDKREDMANHLDWVGVNYYSRDVVKKDGDRWAIVPGYGYATGENKRSLDGRSSSDTGWEVYPEGIYHLVMSYQKHIGLPMMISENGVADDSDRLRPRYVASHLKNLESAIRDGAKVEGYLHWALTDNYEWASGFSKKFGLLKVDFKTKKRYIRPGALVFKEIVENNGVDEDLEWLAADKF

SEQ ID NO: 9709 - protein, 469 aa, Thermoplasma acidophilum
MSKEYDLLILGYGAAAFSAAIKASEITSGQASIAMVGTGPLGGTCVNVGCVPSKMLISAAKNLKYIAKPRYPGLKATYAVETGEVMDFIRMAVDEERHNKYEAVISGYENIDLYRSRAVFTGDRRVKLDDGQELFGYNVLIATGSRPSIPAVPGLANAGYITSNEFWALERIPESLVIIGSGPIGSEIGQAAARLGSRVHIVEIADQILPGISKDMAQMVMDAMASDGVEFSLSSMVKDVSVRNGKKIVRFEKNGVQHEIEADEILVATGRSPNADLDLEKTGVKYDRYGIEVDSTLRTSNRKIYAAGDVVKQRLKLETLASKEGVIAAENMFDHAGISVDLNSFPVAVFTSPEYASVGYTEDEALKAGLNYDVRSIYTTDVPKERILRNDRGMIKIVAEQGTGRIIGIQIVAENAADMINEASAILHAGMTVGDVIDTPHVFPTVNEGIKLAAQSFLRDISMMSCCME

SEQ ID NO: 9710 - protein, 459 aa, Thermoplasma acidophilum
MISSMTESWEELKERAYGPMDKQKSKWFNYKMLLLTGGGIFVDGYNIVIISFGLAGIETLFGLQHNAFLVGLIGISVIIGNLVGALLSGYFVDKVGRRTIFIIDLILFVFFAIISGLVTNAYELVVARLLVGLGIGLDYPIATSYLSEYTPINPRGKFLVMNITFFNIAGVVAAIVGYSLLPLGATIAWRYMLMSAAVPAAITIAGRIRTPESPRWLLEHGRKKEAIQAIERVTESTLPDDTQKFIMDSNVKPPVSGYYKELLTKYTKSAIFIGLFYFFFAIAFVNASLYGPSILASFGEAGLIGSSLYWLLFVVGDIICILVIDSFGRRNSTLTGWAGMLITMIILAFAPSNLKLLSLGAFILFAMFQGIGPGSLHMVYSPELFPTRIRATAEGWKQGIGRLGGVLTGLFFPSLVIGDKLLILILTSIAGLVLSILMAPETKRKGLEEISEKDINLQI

SEQ ID NO: 9711 - protein, 436 aa, Thermoplasma acidophilum
MYDAIIIGSGPGGYAAAIRLGQRQKKVALIEKDKIGGECLNYGCIPSKALIELANSINYLREMPGVSLNYSIDMKKWQEWKWSMINRLTGGVETLCKGYGVDVIRGEAYIVDATHVKIGEKVIEGKNLVIATGSKPVRIKGIDDVMYNREVLDLDHIPESTAIIGGGYIGVEIGTALAKLGSKVTIIEMMPSILPGTDQELVRHVERRLSQLGVRVMTGKKVLNTQHGDKIRVNMEGGEYVEAEKVLMTVGRVPNTEGFGLENLKLEMDGRFIKTDAHKRTSVPNVYAIGDVSGQPMLAHKAYYDADIAADNICGMDSVVEYRAMPYVIYSDPEIAYTGSKSAKSTRFPVAANGRSLTMNESIGTFNIYYDEKGIVTGAGLAAPHASELISELSLAVESGLMAMDIGLTIHPHPTVSEGVKETAEEAYGKPLHFKI

SEQ ID NO: 9712 - protein, 457 aa, Thermoplasma acidophilum
MDMQHDDLNYEYLYGTTYPLMKNAGKAVADAVMKNYPDARTVCVVAGTGNNGGDAIVAGSILSAKYDVRVLIVTEVRSELARRALSEYGGRVIGLDGMEECMKCDVIIDGIFGVGISGDPKDPYRSVIENINRSCSHVVSVDIPSGLGTRYAVKPEITVTFTMEKYGMNQDNSGKIIVADIGIPPDVRKYAGPGDLLYYPKPDPSSHKGMNGTLAIVGGWEFHGSSVIAALAAERIGLDLVRVFVSPRNYQIVSGYDPGIIVRQVEKLDEKKLSEIYGNSAILLGPGMGKGDDAMEAARKIVSDSRVPMVVDADALDAVGAYSGSFAGRKIIITPHKGEFRRISGFEPTEENAISYARKKGLIVVLKGQVDVITNGEEVHYAKGGNARMTMGGTGDLLAGIISAFLARSVDPMRACLMGTYLNKALGEAAYSKHGYWYTVTDMISEIPGVMGKYIKI

SEQ ID NO: 9713 - protein, 364 aa, Thermoplasma acidophilum
MMCLSEEQQILRTSIKDFVKRYVVPGLNEIKNDRFPRDILRELGKNGFFNVMIPGFGVQDSYSYSLIVEELASASPSLAWLYVTHVAAAYALSRMGSEDQKSQYIEKMADGRLLATIAITEPASGATASAVQTKAEFDGKAWVINGSKTFITMASDADAFIIMARSDSEKPAFTDFILRSDDRGVSRSASLKGSGMPGIGWGEIFLENVETGQDRVLGNRNEGIKIIPTIAKVFTIGAASISLGIMDVLNANALEHIRERKINGSSLSSFQVVQDRYLHMYTNGQAASALIYRAAINDDIKLAYAAKVFATEKAIENAVTASRLFGANGYERSVGIASYIDDALAVPLHFINNDVLTGLFMNSV

SEQ ID NO: 9714 - protein, 448 aa, Thermoplasma acidophilum
MAAMPEDLVSKTLKRIEEDKVEFLQMQFTDIIGNVKSLTVPKNRFENALTEGVVFDGSSVAGYAQIEESDMRAIPNLESYTLLPDEFGKNKIARFVCSVYSPDGTRFPGDPRYVLERILDQVHKEGNEFFVGPEFEFFLFKRDEHGNPTTEPSDYGGYFDNTPLDSASDIRQQIMKELYDLGYQPEAAHHEVAYGQQEVDLRYAPALKMADRIVMLKSIIKNIAERNGLYASFMPKPINGVNGSGMHIHQSIMSADEKTNRFYDKNAKYGLSDYAMHYLGGILKYINEASAVLASTVNSYKRLIPGYEAPVYISWANKNRSALVRIPAGEGVRKRMELRCPDPAGNPYLQFAVVLGMGLEGIKNRIEPPEPVEKDIFHMTPEERQAEGIMSMPESLGEALHHLRSSKLMRNVLGDHVYENFITVKQREWDQFRSYVGEWEIKRYLPTL

SEQ ID NO: 9715 - protein, 306 aa, Agrobacterium tumefaciens
MDIRLIGAPLQIGAGQLGCEMGPSAYRIAGLTRALEDLGHRVVDTGNVTPAPLREFSHPNPAVHHLAETVAWTEALTEAAYRESAAAVPIFLGGDHAISAGTVAGMARRVAQSGRPFFVLWLDAHTDYHTLETTRSGNLHGTPVAYFSGRDGFSGYFPPLSHAVPEENIGMIGIRSVDPAERAALEDSGITVHDMRSIDEHGVAVLLRAFLARVQAANGLLHVSLDVDFLEPSIAPAVGTTVPGGATFREAHLVMEMLHDSGLVCSLDLVELNPFLDERGRTATLMVDLAASLMGKRVMDRPTRAG

SEQ ID NO: 9716 - protein, 364 aa, Callistephus chinensis
MKEDSPPTVCVTGAAGFIGSWLVMRLLERGYIVRATVRNPGDMKKVKHLLELPKAETNLTLWKADLTQEGSFDEAIEGCHGVFHVATPMDFESKDPENEIIKPTIEGILSIIRSCAKAKTVKKLVYTSSAGTVNVQETQLPVYDESHWSDLDFIYSKKMTAWMYFVSKTLAEKAAMEAAKENNIDFVSIIPPLVVGPFINPTFPPSLITALSLINGAESHYSIIKQGQYVHLDDLCECHIFLYENPEAKGRYICSKQDATIHQLARMIKQKWPEYHVPTQFAGIDEELPTVSFSSKKLIDMGFKFKYDLEDMFKGAIDSCKEKGFLPYSTNEVKKGLFESSINGNVHGQKGNQKIGDEGVKLVN

SEQ ID NO: 9717 - protein, 2194 aa, Medicago sativa
MSNSLSLTFTALNNPQINAISNPNARLRPLARFTRCSATCVERKRWLGTKLRSGGGPERIQLWESGGLGRLPKLRVAVKSSFSAVPDKPMGLYDPAFDKDSCGVGFVAELNGQSSRKTVTDALEMLVRMTHRGACGCEANTGDGAGILVALPHGFYQEVVDFQLPPQGNYAVGMFFLPKSDSRRMESKNIFTKVAESLGHKVLGWRSVPTDNTGLGKSAQLTEPVIEQVFLTPSSDSKVDLEKQMYILRKLSMVSITSALNLQSDGITDFYICSLSSRTVIYKGQLTPAQLGEYYYADLGNERFTSYMALIHSRFSTNTFPSWDRAQPFRVLGHNGEINTLRGNVNWIKAREGLLKCKELGLSENDLKKFLPIVDANSSDSGCFDGVLEFLLHSGKSLPEAVMMMIPEAWQNDKNMDPQRKAFYEYYSALMEPWDGPALISFTDGHYLGATLDRNGLRPGRFYVTHSGRVIMASEVGVVDIPPEDVCRKGRLNPGMMLLVDFEKQIVVNDDALKEQYSLARPYGDWLEKQKIELKDIIDSVHESDIVPPTISGVPPLSNDDVDMENMGIQGLLAPLKAFGYSVESLEILLLPMAKDGVEALGSMGNDTPLAVMSNREKLTFEYFKQMFAQVTNPPIDPIREKIVTSMRCMVGPEGDLTETTEEQCHRLSLKGPLLSTKEMEAIKKMNYRGWRSKVIDITYSKERGTKGLEEALDRICTEAHNAISEGYTTLVLSDRAFSKKRVAVSSLLAVGAVHQHLVKTLERTRVALMVESAEPREVHHFCTLVGFGADAICPYLAIEAIWRLQVDGKIPPKASGDFNSKDELVKKYFKASTYGMMKVLAKMGISTLASYKGAQIFEALGLSSEVIEKCFAGTPSRVEGATFEMLAQDALHLHELAFPSRIFSPGSAEAVALPNPGDYHWRKGGEVHLNDPLAIAKLQEAARTNSVDAYKQYSKTIHELNKACNLRGLLKFKDAASKVPISEVEPAGEIVKRFCTGAMSYGSISLEAHTALATAMNTIGGKSNTGEGGEQPSRMEPLADGSRNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHAEHVLISGHDGGTGASRWTGIKSAGLPWELGLAETHQTLVANDLRGRTTLQTDGQLKTGRDVAIAALLGAEEYGFSTAPLITLGCIMMRKCHKNTCPVGIATQDPVLREKFAGEPEHVINFFFMVAEEMREIMSQLGFRTVNEMVGRSDMLEVDKEVVKGNAKLENIDLSLLLRPAAELRPEAAQYCVQKQDHGLDMALDNKLISLSNAALEKGLPVYIETPICNTNRAVGTMLSHEVTKRYNLAGLPADTIHIQFTGSAGQSFGAFLCPGITLELEGDSNDYIGKGLSGGKVVVYPPKGSNFDPKDNILIGNVALYGATRGEAYFNGMAAERFCVRNSGAQAVVEGVGDHGCEYMTGGTVVVLGKTGRNFAAGMSGGIAYVLDVDGTFQSRCNLELVDLDKVEEEEDIITLRMLIQQHQRHTNSLLAKEVLVDFENLLPKFVKVFPREYKRVLASMKSDAASKDAVERAAEDVDEQDDEAQAVEKDAFEELKKLATASLNEKPSEAPKRPSQVTDAVKHRGFVAYEREGVQYRDPNVRLNDWNEVMMETKPGPLLKTQSARCMDCGTPFCHQENSGCPLGNKIPEFNELVYQNRWQEALERLLETNNFPEFTGRVCPAPCEGSCVLGIIENPVSIKNIECAIIDKAFEEGWMIPRPPVKRTGKRVAIVGSGPSGLAAADQLNKMGHIVTVFERADRIGGLMMYGVPNMKTDKVDIVQRRVNLMAEEGINFVVNANIGLDPLYSLERLREENDAIVLAVGATKPRDLPVPGRELSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAETKFGKDPRTYEVLTKRFVGDENGVVKGLEVVRVCWEKDETGKFQFKEIEGSEEIIEADLVLLAMGFLGPEATIAEKLGVERDNRSNFKADYGRFSTSVDGVFAAGDCRRGQSLVVWAISEGRQRAAQVDSYLTNEDHGIDGNQDEFVKRQQDLNKKHSKHTVMT

SEQ ID NO: 9718 - protein, 360 aa, Dianthus caryophyllus
MVSSTINETLDGKHDINKVGQGETVCVTGASGFIGSWLIMRLLERGYTVRATVRDPDNTKKVQHLLDLPNAKTNLTLWKADLHEEGSFDAAVDGCTGVFHIATPMDFESKDPENEMIKPTINGMLDILKSCVKAKLRRVVFTSSGGTVNVEATQKPVYDETCWSALDFIRSVKMTGWMYFVSKILAEQAAWKYAAENNLEFISIIPPLVVGPFIMPSMPPSLITALSPITRTESHYTIIKQGQFVHLDDLCMSHIFLYENPKANGRYIASACAATIYDIAKMLREEYPEYNVPTKFKDYKEDMGQVQFSSKKLTDLGFEFKYGLKDMYTAAVESCRAKGLLPLSLEHHLCVFRVTLIFFK

SEQ ID NO: 9719 - protein, 104 aa, Salmonella typhimurium
DVEVRVDYCGICHSDLSMIDNEWGFSQYPLVAGHEVIGRVAALGSAAQDKGLKVGQRVGIGWTARSCGHCDACISGNQINCQEGAVPTILNRGGFAEKLRAGWQ

SEQ ID NO: 9720 - protein, 437 aa, Saccharomyces cerevisiae [sequence omitted]

SEQ ID NO: 9721 - protein, 153 aa, Pseudomonas aeruginosa
GTTAKPHVLIATSLGEIEVELDPAKAPISVKNFLEYVDSGYYDGTLFHRVIPGFMVQTGGFSAGMQEKKTRAPIKNEADNGLLNERGTLAMARTGVVDSATSQFFINLTDNDFLNHGARDFGYAVFGKVVRGMGVVDQIAKVPTTRRNGFASL

SEQ ID NO: 9722 - protein, 329 aa, Pseudomonas sp.
MSSTEPAAAAAGLAIPALGYGAANVGNLFRALSDDEAWAVLEAAWDAGIRYYDTAPHYGLGLSEKRLGAFLQTKPRDEFVVSTKAGRLLRPNPERRPSGLDTDNDFHVPDDLRREWDFTEQGIRASIAESQERLGLDRIDLLYLHDPERHDLDLALASAFPALEKVRAEGVVKAIGIGSMVSDALTRAVREADLDLIMVAGRYTLLEQPAATEVLPACAENATGIVAASVFNSGLLAQSEPKRDGRYEYGQLPDELWDRLVRIAAICRNHDVPLPAAAIQFPLQSALVRSVVVGGSRPAQLTQNAEYAALEIPAGLWAELAEARLIPTP

SEQ ID NO: 9723 - protein, 220 aa, Pseudomonas syringae pv. syringae
MSVSERRVSRLFDPGSFKEDLEGQNTHFICGAGTIHGFSRDGQPARQVFAVVANNSAHGGGVMYKRTARKMIHVIGLAGKMSLPILFIADIPGIMIGEEAERDGIFAAVADLFRAHTRCKVKKLLLVARKAYTGGVYAMSGPGFEPVAVLAYPDANIGVFSTLTMEKIIKSSSMTDAQRAVVSALDEEIRSPLLLKDKGLITDVISVRDTRQAVFKYLFH

SEQ ID NO: 9724 - protein, 305 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAQRGNDSAAMSTRTGK

SEQ ID NO: 9725 - protein, 205 aa, Streptomyces coelicolor
MRIVLVGPPGAGKGTQATRLAETLHIPHISTGDLFRANISQQTELGKLAKSYMNAGNLVPDEVTIAMAKDRMEQPDAEGGFLLDGFPRNVSQAEALDELLETEGMKLDAVLDLEAPEDEVVKRIAGRRVCRNEPKHVFHVTYTPPKKEGVCDVCGGELYQRDDDSEETVRKRLEVYHTQTEPIIDYYKSQGLVPPSRAAPWTRSP

SEQ ID NO: 9726 - protein, 464 aa, Spiraeopsis celebica
  misc_feature (76)..(76): Xaa can be any naturally occurring amino acid
GFKAGVKDYKLTYYTPDYETKDTDILAAFRVSPQPGVPPEEAGAAVAAESSTGTWTTVWTDGLTSLDRYKGRCYHXEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9727 - protein, 465 aa, Pseudoweinmannia lachnocarpa
  misc_feature (4)..(4): Xaa can be any naturally occurring amino acid
  misc_feature (318)..(318): Xaa can be any naturally occurring amino acid
VGFXAGVKDYKLTYYTPDYETKDTDILAAFRVSPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHXGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9728 - protein, 465 aa, Acrophyllum australe
VGFKAGVKDYKLTYYTPDYETKDTDILAAFRVSPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9729 - protein, 463 aa, Crinodendron patagua
FKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 9730 - protein, 386 aa, Lycopersicon esculentum
MASTKQYFSAAGKPIRCKAAVARKAGEPLVIEEVIVAPPKAHEVRRKIICTSLCHTDITLWKLKGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 9731 - protein, 281 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQRVIAEMTDGGVDRSVECTGHIDAMISA

SEQ ID NO: 9732 - protein, 471 aa, Saccharomyces cerevisiae
HLFKEVTPLRSQYLRNSTTSTFNHGSSTETPAENGLPRPMEFYLSSDCASLARYVSKVVYLEDNDIAHIYDGELHIHCSKIGSEDFSFRTVQKLELELSKIKKGPYDNFMQKEIYEQCETTKNVMRGRVDAFTNRVVLGGLENWLTELRRAKRIIMIASKASFHSCLAARPIFEELMEVPVNVELALDFVDRNCCIFRNDVCIFVSRSGETTDTINALNYCIKKEAVTIGVVNCSGSSISRFTHCGVHTNTGPEKGIATTKSYTSQYIALVMIALWMSEDLVSKIERRKEIIQALTIVPSQIKEVLELEPLIIELCDKKLKQHDTFLLLGRGYQFASALEGASKMKEISYVHSESILTNELGHRVLAVASDNPPIIAFATKDAFSPKIASCIDQIIERKGNPIIICNKGHKIWEQDKQKGNVVTLEVPQTVDCLQGILNVIPLQLISYWLAIKKDIGVDLPRDSAMSAPDI

SEQ ID NO: 9733 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 9734 - protein, 324 aa, Nicotiana tabacum
MEEKSDIAKDVTELIGNTPMVYLNKIVEGCAAQIAAKLESMEPCSSVKDRMAYSMIKDAEDKGLITPGKTVLLEVTSGNTGIGLAFIAAARGYKLVTVMPASYSLERRIVLKALGSELYITDPAKGIDGVLQKAEEILDRTPNCHFFRQFENPANPKIHYETTGPEIWKCTGGKIDIFIAGIGTGGTVTGAGRFLKEKNPEIKVYGMEPARKCNSEWRTKGPHKIQGIGAGFVPVVLDLSILDEVLQVSSDEAIEMTKLLALKEGLLVGISSGAAAAAAIKVAKKPENAGKLIAVIFPSFGERYLSTVLFDSIREEVANMTFEQ

SEQ ID NO: 9735 - protein, 169 aa, Nicotiana tabacum
MASQSSKPQSIYDFTVKDAKGNDVDLSIYKGKVLIIVNVASQCGLTNSNYTDMTEIYKKYKDQGLEILAFPCNQFGGQEPGSIEEIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 9736 - protein, 486 aa, Solanum tuberosum
MGLVSENYNKKLLSKIATNDGHGENSAYFDGWKAYENDPFHPTQNPHGVIQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFSQPSFISISEVMSEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLEKSTFDDELKLWHIIINKVKLNVSPGCSFHCSEPGWFRVCFANMDDATMQVALKRIRHFVYLQPSKGVEVATKKQYCRTRSKLEISLSFRRLDDFMNSPHSPMSSPMVQARN

SEQ ID NO: 9737 - protein, 355 aa, Botryotinia fuckeliana
MTARAPNPASGSRKISFNVSEQYDIQDVVGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKKLIYDEIMR

SEQ ID NO: 9738 - protein, 170 aa, Sorghum bicolor
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 9739 - protein, 397 aa, Streptomyces coelicolor A3(2)
MAASPKLPAFDPADPLGIDDLLEPEDLAVRDTVRSWAADRVLPHIADWYESGELPGIRELARELGGIGALGMSLEGYGCAGASAVQYGLACLELEAADSGIRSLVSVQGSLAMYAIHRFGSEGQRQEWLPRMAGGEVIGCFGLTEPDHGSDPANMRTNAKRDTGGDWVLNGRKMWITNGSVAGVAVVWAQTEEGIRGFVVPTDSPGFSAPEIKHKWSLRASVTSELVLDDVRLPADAVLPEATGLRGPLSCLSHARYGIVWGSMGAARSSFEAAVEYAKSREQFGRAIGGFQLTQAKLADMAVELHKGILLAHHLGRRMDAGRLRPEQVSFGKLNNVREAIDICRTARTILGANGISLEYPVMRHATNLESVLTYEGTVEMHQLVLGKALTGLDAFR

SEQ ID NO: 9740 - protein, 497 aa, Geobacillus thermoleovorans
MTMISAQTTEADLWIDGEWRPAASGERFDVIDPATGEVTARVANAGEDDVDAAVAIAEEAFSVRRWLAISPLERGRILRRIAELIRQHHCELAQLMTRENGMPINLALFIEIPLADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTVPFGGYKQSGLGRELGMQALDAYLETKTVICDLNDRPMTLF

SEQ ID NO: 9741 - protein, 378 aa, Solanum tuberosum subsp. andigena
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 9742 - protein, 375 aa, Solanum tuberosum subsp. andigena
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 9743 - protein, 271 aa, Solanum tuberosum subsp. andigena
AQVYIDKFFELPLCEKQKAQRRVGEHCGYASSFIGGFSSKLPWKETLSFQYSDEEGSSHIVEQYFQRTLGEQFSYIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 9744 - protein, 156 aa, Carboxydothermus hydrogenoformans
  misc_feature (131)..(131): Xaa can be any naturally occurring amino acid
IAPIAEKTDREHRFPKETLDKLAELGLMGIPISEEYGGAGADYFSYILFIEEIAKVCASTAVILAVHIGLGCMSIYMFGTEEQKQKYLVPMAQGRMLGAYALTEPNSGSDAASLRLSAVDKGDHFVLNGSXIFITNGSYADVFITLARTDPLPTGG

SEQ ID NO: 9745 - protein, 359 aa, Streptomyces coelicolor A3(2)
MSALFEPFRLRDTTIPNRIWMPPMCQYSAAPEGPSAGVPGDWHFAHYGARAVGGTGLIVVEATGVSPEGRISPQDLGLWNDTQVEAFRRITGFLRSQGTVPAVQLAHAGRKASTAQPWRGGAPVGADAYGWQPLAPSALAFDERHPVPTELTVPQIQEAVGRFADAARRALAAGFEIAEIHGAHGYLIHEFLSPHSNQRTDAYGGSYANRTRFALEVVDAVREVWPDDKPLFFRVSATDWLEEGGWTPDDTVRFARDLEAHGIDLLDVSTGGNVPRVRIPTGPGYQVPFAARVKAGSTLPVAAVGLITEPGQAEKILANGEADAVLLGRELLRNPSWAQHAARELGVDARMPDQYGWGM

SEQ ID NO: 9746 - protein, 319 aa, Rhizopus stolonifer
AEFWDFLMDESVSFSKKQTLENLSYAAFGLGNKTYEHYNEMIRRVDQRLENLGAKRVGERGEGDDDGTLEEDFLAWQEKMWPEFCQALGVDQNQSKTGPRHAVFKVQELSLYDQDKVYLGEIGEWLKKDGAAIYSAKRPYNAIMTSKELFKTSDRSCLHLEIDISGTNLVYQTGDHVAIWPTNNELQVNLLAQLLGLQGKLDHVIQVEAIDSAASKKYPFPVPTTYRTVFRHYLDISAVVSRQTLMSLVDYAPTESSRKLLKKLSADKETYRVLVGDVTRSLGEVLQMLAIEDSLPPEGVFASVPFDLIVDSLSRLQPR

SEQ ID NO: 9747 - protein, 317 aa, Rhizopus stolonifer
VEFWGLMVDEQPMFSNEAEQSPLQNLRYITFGLGNKTYEHYNEVVRKVDNRLLALGAKRIGERGEGDDDGTLEEDFLAWQEEMWPAFCEASGVDESNAVTGPRQAIYGVEELSSFDQTKVYLGEIGEWLKEGAPKVYEAKRPYNAPITSKELFNGGDRHCLHLEIDISGTNLSYQTGDHIAIWPVNNEVEVNRLARLLGLEDKLDSVIHVQALDAAASKKHPFPVPTTYRAAFRHYLDICSVASRQVLVSLIEYAPTEQAKEALKRLATDKDEYRVHVGDVTRNLGEVLELVSGSQENFATVPFDLIVESISRLQPR

SEQ ID NO: 9748 - protein, 329 aa, Saccharomyces cerevisiae
GGHDVPLTNYLNAQYYTDITLGTPPQNFKVILDTGSSNLWVPSNECGSLACFLHSKYDHEASSSYKANGTEFAIQYGTGSLEGYISQDTLSIGDLTIPKQDFAEATSEPGLTFAFGKFDGILGLGYDTISVDKVVPPFYNAIQQDLLDEKRFAFYLGDTSKDTENGGEATFGGIDESKFKGDITWLPVRRKAYWEVKFEGIGLGDEYAELESHGAAIDTGTSLITLPSGLAEMINAEIGAKKGWTGQYTLDCNTRDNLPDLIFNFNGYNFTIGPYDYTLEVSGSCISAITPMDFPEPVGPLAIVGDAFLRKYYSIYDIGNNAVGLAKAI

SEQ ID NO: 9749 - protein, 416 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 9750 - protein, 326 aa, Aspergillus sp.
MRFTPLFLLAAVAIASPAPDLNARHELTRRQASESCPIGYCTQNGGTTGGAAGDTVTVTNLADLTEAAESDGPLTIIVSGSISGSAKIRVASDKTIFGESGSSITGIGFYIRRVSNVIMRNLKISKVDADNGDAIGIDASSNVWVDHCDLSGDLSGGLDDLDGLVDISHGAEWITVSNTYFHDHWKGSLIGHSDNNEDEDLGHLHVTYANNYWYNVYSRTPLIRFATVHIINNYWDSLIDTGVNCRMDAQVLIQSSAFHNCPDRAIFFADSDYTGYAVVDDVDLGGSSNSVPEGTLTPSSLPYAAITALGSGQVASVIPGTAGQKL

SEQ ID NO: 9751 - protein, 216 aa, Cucurbita argyrosperma
MDSKEKEAREKLGREVKLGHCLDVILKNADVALHYPSFLKLYDQLVAGILLNKGAIKYIFDKKLNSHWYFIFARALSIAWIEDKRYWKWGSCNEIAELIQVSWLDIRGKIKESMLSPNIVYEVALQVQLNSGASGWNHPMNIELKKPNGSKIERQECLLGKPKNQWFEIVIEFKVDNHGCGSSGEIEFGFYEHGGHWKSGLLVKGVRIGAKGCGCA

SEQ ID NO: 9752 - protein, 216 aa, Cucurbita argyrosperma
MVNNEKEAREKLGGEVKLGHCLDVILKNADVALHYPSFLKLYDQLVAGILLNKGAIKYIFDKKSNSNWYFIFARALSIAWIEDKRYWKWGSCNKIAELIQVSWLDIRGKIKESMLSPNIVYEVALQVQLNSGASGWNHPMNIELKKPNGSKIERQECLLGKPKNQWFEIVVEYKVGNPGCGSSGEIEFSFFEHGGHWKRGLLVKGVRIGAKGCGCA

SEQ ID NO: 9753 - protein, 461 aa, Mesembryanthemum crystallinum
MQSQSNDEDNNAHYDFDLFVIGAGSGGVRAARFSAKFGAKVGICELPFHPISSEVIGGVGGTCVIRGCVPKKILVYGASFSGELQDARNYGWELNENIDFNWKKLLQKKTDEILRLNNIYKRLLSNAGVKLYEGEGKIVSPNEVQVTQLDGTKLSYSAKHILIATGSRAQRPDIRGQELAITSDEALSLEELPKRAVILGGGYIAVEFASIWRGMGATVDLFFRRELPLRGFDDEMRAVAARNLEGRGVNMHPRTNLTELVKTDGGIKVRTDHGEELMADVVLFATGRSPNTKRLNLDAVGVNVDKTGAIKVDDYSQTSVPSIWAIGDVTNRMNLTPVALMEGTCFAKSLFGGQPTKPDYKDIPCAVFSIPPLSVVGLSEEQAIEQSNGDVLVFTSSFNPMRNTISQRQEKSVMKLVVDAETDRVLGASMCGPDAPEIMQGIAVALKCGATKAQFDSTVSR

SEQ ID NO: 9754 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQLNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADDTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 9755 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENPCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 9756 - protein, 215 aa, Neisseria mucosa
MKVLLLGAPGAGKGTQAQFITAAFGIPQISTGDMLRAAIKAGAPLGLEAKKIIDEGGLVRDDIIIGMVKERIAQDDCKNGFLFDGFPRTLAQAEAMVEAGVDLDAVVEIDVPDSVIVDRMSGRRVHLASGRTHHVTYNPPKVEGKDDVTGEDLIQRDDDKEETVKKRLAVYHEQTEVLVDFYSKLEGEHAPKYIKVDGTQPVEAVKAEILGALGK

SEQ ID NO: 9757 - protein, 215 aa, Neisseria meningitidis
MKALFLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQPVEAVKAEVLGALGK

SEQ ID NO: 9758 - protein, 215 aa, Neisseria meningitidis
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNSPKVEGKDDVTGEDLIQRDDDKEETVKKRLAVYHEQTEVLVDFYSKLEGEHAPKYIKVDGTQPVEAVKAEVLGALGK

SEQ ID NO: 9759 - protein, 215 aa, Neisseria meningitidis
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQAVEAVKAEVLKGLGK

SEQ ID NO: 9760 - protein, 215 aa, Neisseria meningitidis
MKALLLGAPGAGKGTQAQFITAAFGIPQISTGDMLRAAIKAGTPLGLEAKKIIDKGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQAVEAVKAEVLKGLGK

SEQ ID NO: 9761 - protein, 453 aa, Thermoactinomyces vulgaris
LSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRQIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 9762 - protein, 362 aa, Colletotrichum gloeosporioides f. sp. malvae
MRVLPMIAGFAALASAAPAELDTRASCTFTDAKTAMSKKTSCTDIVLNGIKVPAGQTLDLTGLKDGTRVTFKGTTTFGYKEWEGPLIAVGGKKVAVVGASGSLISCEGERWWDGKGGNGGKKKPKFFKVKINDGSITGLKVKNTPVHGFSINSVKGLKVVNVEFNNKDGDTKGGHNTDVFDVGQSEDVTISGAKVYNQDDCLAINSGTRITFENGYCYGSHGLSIGSVGGRTSNTVKDIVIRDSTIEKADNGIRIKTIAKKTGSVSGITFENITLKNINKKGIVVQQDYENGSPTGKPTAGIPITGVTAKNLKGTVASKGTNVYVLCAKGACSNWKWSGVSVTGGKSSTECSGIPSGSGAKC

SEQ ID NO: 9763 - protein, 487 aa, Pseudomonas syringae
MSLISEFRSVVAQQPDTTAVVEDQRAFSFTELAQLADKVSAGLLQGLQPGDRVAIHLGNRLELVALYYACLEIGAVTVPINRRLVAGEIEHLLHHSGARYYIGEQETYSRYAAVIAGSATLERAWIVAGEEALKGERYLPWSDLLVSSPSKRPPSHADSLAAIFYTSGTTGITKGIVHSQATLAQAVALMKAMMPPARLKVPSTRAAVHSMMDAIVPWSILMILAAHRLGRAVVLLPVLTAETTLALLQRLPLSFLKGAPSHFNNLLAAGEASAAPPLPSLTSTYSVSGDLCPPKLGRRWHDLWGGTLRGSYGTTESGPIFCQPDVAGTEQSSIGWPLPGVALQQTETGELLIRSPANTPGLWNGQDADRLPATRWIATGDLVQRQDDGGYLIIGREKDMLKCDAYSISPVEVEQELLKLLDIAEAVVFGVPDATIGERPVALLRTTSGRELPTQQLKQHLKALIAEYKHPRQYLFVDVFRCPPRGR

SEQ ID NO: 9764 - protein, 467 aa, Tetraena mongolica
SVGFKAGVRDYKLTYYTPEYETKDTDILAAFRVTPQPGVPPEEAGAAVAAESSTGTWTTVWTDGLTSLDRYKGRCYNLEAVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAACARELGVPIVMHDYLTGGFTANTTLAHYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAASEVWKEIKFEFPAMDTLD

SEQ ID NO: 9765 - protein, 469 aa, Polyosma cunninghamii
TKASAGFKAGVKDYKLTYYTPDYDTKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGVPIVMHDYLTGGFTANTTLAHYCRDNGILLHIHRAMHAVIDRQKNHGMHFRVLAKGLRMSGGDHIHGGTVVGKLEGERDITLGFVDLLRDDYIVKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTI

SEQ ID NO: 9766 - protein, 469 aa, Quintinia verdonii
TKASSGFKAGVKDYKLTYYTPDYETKDTDILAAFRVTPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 9767 - protein, 480 aa, Alcanivorax borkumensis
MVAEVKDLHRNNPDIARLQSIFTAQKAAYRQNPYPSAEQRLELISRLKPLLVDHVDAWIDALNNDFTTRAADETKLAEIMMTLEGLKYTTKKLRKWMKPSKRHVSAMNWPGKTWVEYQPLGVVGIIVPWNYPVQLAVVPLITALAAGNRVMIKMSEATPRTGALLEKLITNIFPQEQVAVINGEVDVAQAFSELPFDHLLFTGSTTIGKHIMRAASANLTPVTLELGGKSPCIIGQDFPMKDAAERIAFGKCLNSGQTCVAPDYILCPENRVQEFVDAWKAQVTQSYPTMVNNPDFTAIVNPRQQKRLLGYLDDAKAKGADVIEINPANEDFSGSQKVPHTLVLNVNDDMDIAQDEIFGPLMIVVPYKTLDEAIEYVNDRPRPLALYYFDWNQDNCNRVLKNTHSGGVCLNDTISHVGVDDIPFGGIGPSGMGAYHGPEGFQTFSQAKGIYKKGKMNATKYILPPYGRSIHKLIYKFLLK

SEQ ID NO: 9768 - protein, 196 aa, Bacillus pumilus
MTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEF

SEQ ID NO: 9769 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 9770 - protein, 178 aa, Glycine max
  misc_feature (178)..(178): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGX

SEQ ID NO: 9771 - protein, 501 aa, Lotus corniculatus var. japonicus
MALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 9772 - protein, 247 aa, Bacillus subtilis
MLTVKGLNKSFGENEILKKIDMKIEKGKVIAILGPSGSGKTTLLRCLNALEIPNRGELAFDDFSIDFSKKVKQSDILQLRRKSGMVFQAYHLFPHRTALENVMEGPVQVQKRNKEEVRKEAIQLLDKVGLKDKMDLYPFQLSGGQQQRVGIARALAIQPELMLFDEPTSALDPELVGEVLKVIKDLANEGWTMVVVTHEIKFAQEVADEVIFIDGGVIVEQGPPEEIFSAPKEERTQRFLNRILNPL

SEQ ID NO: 9773 - protein, 354 aa, Agrobacterium tumefaciens
MEYRLLGRSGLKVSTLTVGTMTFGGVGWAKTVGDLGVTEAKRLVDLCLDAGINLIDTADVYSDGKSEEILGEILGGKRKGGALVATKARFNMGPGPNDGGLSRQYLIAACEASLKRLKTDVIDLYQLHEWDGQTPLEETMEALDTLVRQGKVRYIGCSNFTGWQIMKALGISEKDKRQRFVSQQIHYTLEARDAEYELLPISVDQGLGVLIWSPLAGGLLSGKHRRNQSAPEGSRQFAGWTEPPVRDEERLWNIVDTLLSVADGRGVSAAQVALAWLIGRKAVTSIIIGGRTEAQFKDNLAAADLQLSAEERKRLDDVSLLQLLYPYWHQRNNASDRLSEADLELLAPHLSKKG

SEQ ID NO: 9774 - protein, 473 aa, Clostridium longisporum
MSFDLSFPKSFLWGGATAANQFEGAYNEDGKGLSIQDIAPKGVMGPITEVPTEDNMKLIGIDFYHRYKEDIKLFAEMGFKTFRLSIAWSRIFPNGDDEIPNEKGLEFYDKVFDELQRYGIEPLVTLSHYETPLNLSKKYNGWANRDLIGFYERYVRTVFTRYKDKVKYWLTFNEINSAIHAPYMSAGIWTDKSELSKQDLYQAMHHELVASALAVKIGHEINPDFKIGCMILGIPVYPLTPHPDDLIEKMRVERESLFFADVHARGKYPRYMNRLFKENNIEIKWHEDDAEILSNVVDFISFSYYMSSCATADEEKKKAGAGNLLAGVPNPYLKASEWGWQIDPKGLRLILNELYDRYEKPLFIVENGLGAVDELVTDENGNKTVNDDYRIKYLNDHLVQVAEAIEDGVELMGYTTWGCIDLVSASTAELKKRYGFIYVDRHDDGSGTLERYKKKSFNWYKEVIATNGKSLER

SEQ ID NO: 9775 - protein, 164 aa, Anabaena variabilis ATCC 29413
MRRLFALILVICLSFSFAPPAKALGADLTPCAENPAFQALAKNARNTTADPQSGQKRFERYSQALCGPEGYPHLIVDGRLDRAGDFLIPSILFLYIAGWIGWVGRAYLQAIKKDSDTEQKEIQLDLGLALPIIATGFAWPAAAVKELLSGELTAKDSEITVSPR

SEQ ID NO: 9776 - protein, 462 aa, Burkholderia vietnamiensis
MSHSGLTRTAAAPPSLSRHAVDTARLAAPLAIAQLSQMAMSVTDTVLLGSLGPDSLAAGGLGANFFFVIVTVLQGVLSSVSVSVAHARGAQAEHRVPHIYWTGFVLSVLLAIPAVVALSLSEPLLLMFHEPPTLAQHVGEYTGILRFAALGSLIGVGLMRAFLPAIGAARRLLWVSIGGIGVNAVLNYGLIHGAYGLPRLGFLGSAVATTITIWLTAFALIWLLHGRARFRHFVSAARPKLPMMGELIGIGWPVAITYGVESTLFLATGLTVGVLGATALAAHQIALNVASVAFMVPLAIGQAANVRVGYWIGAGDPVAARHAGFVALGLGVAFMSLSGLVLILAPHAIVGLYLHLDDPANAATVSLAASLLGIAAVFQIVDGMQTVGSGALRGLRDTRIPMLAATFGYWGIGFPTGYWLAFHAGLGARGLWWGLAAGLASVAVLMAWRFHLKTSSLIAAPR

SEQ ID NO: 9777 - protein, 308 aa, Geobacillus stearothermophilus
MARTVNSITELIGDTPAVKLNRIVDEDSADVYLKLEFMNPGSSVKDRIALAMIEAAEKEGKLKPGDTIIEPTSGNTGIGLAMVAAAKGYKAILVMPDTMSLERRNLLRAYGAELVLTPGSQGMRGAIEKAEELVREHGYFMPQQFKNEANPEIHRLTTGKEIVEQMGDQLDAFIAGVGTGGTITGAGQVLREKYPNIKIYAVEPADSPVLSGGKPGPHKIQGIGAGFVPDVLDTNIYDEVITVTTEEAFAAARRAAREEGILGGISSGAAIHAALKVAKQLGKGKKVLAIIPSNGERYLSTPLYQFED

SEQ ID NO: 9778 - protein, 505 aa, Limnanthes douglasii
MSETKPEKPLIATVKNTLPDLKLSINLKHVKLGYHYLITHGMYLCLPPLALVLFAQISTLSLKDFNDIWEQLQFNLISVVVSSTLLVSLLILYFMTRPRPVYLMDFACYKPDETRKSTREHFMKCGESLGSFTEDNIDFQRKLVARSGLGDATYLPEAIGTIPAHPSMKAARREAELVMFGAIDQLLEKTKVNPKDIGILVVNCSLFSPTPSLSSMIVNHYKLRGNIISYNLGGMGCSAGLISVDLAKRLLETNPNTYALVMSTENITLNWYMGNDRSKLVSNCLFRMGGAAVLLSNKTSDKKRSKYQLVTTVRSHKGADDNCYGCIFQEEDSNGKIGVSLSKNLMAVAGDALKTNITTLGPLVLPMSEQLLFFATLVARKVFKKKIKPYIPDFKLAFDHFCIHAGGRAVLDELEKNLQLSSWHLEPSRMTLYRFGNTSSSSLWYELAYSEAKGRIRKGERVWQIGFGSGFKCNSAVWKALKSVDPKKEKNPWMDEIHQFPVAVV

SEQ ID NO: 9779 - protein, 340 aa, Streptomyces coelicolor A3(2)
MIHPHIADALKVPDLVRLNDDLVLIRFESMKIYSALAAVRHLLERGTIRPGQTLIDSSSGIYAYALALACHRYGMRCHVVASTTVDTTTRAQLEILGATVEQVRPSRNLKLDQELRVRRVREILADHPDWHWMRQYHDDVHYLGYQEVADRITTAFPSTPLTVVGGVGSGASTGGLVERLRATDPSVRLVGVQPFGSVTFGSQAHHDPEAIIAGIGSSIVFDNVRHHLYDAVHWLDFTHAMSGTIALLRERAVFAGLSTGAGYLAATYEARRHPDRLHLVIGADTGHRYVERVFARHTEALDPAPLKPVEVSAPEEMSMPWSRMAWRRTACPAGRKERAA

SEQ ID NO: 9780 - protein, 313 aa, Streptomyces coelicolor A3(2)
MNTMRAIGQDVLGGPEVLKEVRPERPEPRPNEVLVRVRAAGVNPTDWKHRATGGFLGEPPFVLGWDVSGVVESVGIGVAAFRPGDEVFGMLSYPFGHGSHAEYVTAPARTFTRKPSGIDHVQAGALPLVSLTAWQALVERAEVQPGQRVLVHAAAGGVGHVAVQIAKARGARVIGTASAAKHEFLRSLGADETVDYRETDFAEAVKDVDVVLDTIGGDTSLRSLRVLRPGGVVVSILPVGSDDFYEEADRLGVRAVRMLVDADRAGMEEIARLVGAGRLRATIAQTFPLAEAARAHALGETGRTTGKLVLEVD

SEQ ID NO: 9781 - protein, 308 aa, Erwinia amylovora
MKKRIWVLGDAVVDLLPGQDNLLLKCPGGAPANVAVGIARLGGNSAFIGCVGDDPFGEFMQTTLQREGVDIGKMFRIDGQRTSTVLVSLDTEGERHFTFMVRPSADLFLRTDCLPSFAQGEGLHLCSIALSAEPSRGAALHAMHAIRQAGGWVSFDPNLRADLWPDADEMARSVAQAFELADIIKLSEDELVFLTGLAILEQGIDQFTARYQPALLLVTRGSQGVSVWQAGRLQHFAAPQVEVTDTTGAGDAFVAGLLAALVQETNPLQPQRLDFAVQQAQHSGAAATTAKGAMTALPYAKDLVRFSQ

SEQ ID NO: 9782 - protein, 455 aa, Schizosaccharomyces pombe
MGRPLTEVKYLLINSAPVILGYALQNSLQTSSVIVTGRLGPSELSVAAFAYMFAMSTGWLIALGGTTAFDTLGSNLWGAGKKQELGILLQTGFIVLSILYLPICLVWWYSKPILIFLHQTPELAEASQKFLRYLIPGGLGYVCFELLKKFLQTQEITRAGSYILLVTSPLNVALNFLLVHYYGLGLKGAPLATGLSYWLSFILLTQYAKYVKGAEAWNGWNKRCLENFGPFVKLSLLGIVMVGTEWWAFEIVALVAGKLGAVPLAAQSVIMTTDQLLNTIPFGLGIITSNRVAYYLGAGLPDNASLTAKVAAIVGVAVGSVIMITMIAVRNIYGRIFTNDPDVIQLVALVMPLVAAFQISDSLNGTMGGALRGTGRQKVGAIVNITAYYLFALPLGIYLAFHGKGLVGLWIGQVIALSIVGILELKIVMATDWISQSRKAISRFGDSSELTALLN

SEQ ID NO: 9783 - protein, 394 aa, Schizosaccharomyces pombe
MALQSLFLILLAGAAQLAQAHPKIFEQSRANAVETFDDAFPGDGETQADSVFSGIATFGRLPYWKCLNDKSQSFDIAFLGAPFDTGTSYRPGARFGPSGIREGSRRLNLYGGYNVPMETNPFNNWAKIVDCGDIPLTSYDNAVAIKQIENGHFELLTRKPTSYSEKDGYALDGSVLPRVITLGGDHTIVLPILRSVSRAYGPVSIIHFDSHLDSWKPKVFGGGKSSVGSINHGTYFYHASQEGLVSNDSNIHAGIRTTLSGLSDYDNDADCGFEIIEAREIDTIGIDAIIKRIRDRVGDGIAYLSIDIDVLDPAYAPATGTPESAGWTTRELRTILRGLDGIKLVGADIVEVAPAYDFAEVTTLAAADILFEVMSIMVKTPVYKEQAKQQSRFY

SEQ ID NO: 9784 - protein, 373 aa, Streptomyces rishiriensis
MTSAHSSNSASTTCAAGAGKLPATEPDGIAGKDSWLAAAELGMTGLCLPTEHGGGGLGALDTALCLEAFCRWRGHRPPFGIAAHLLACGTVLADHAGEPVRAELLQGLASGTVVAANAMTEDDAGSDLSRLTTTAVADGDSYVLNGRKSFVSNAPLADVFITYAATAPSAGYLGMSAFAVPRTLPGLQVGSLLAKMGLNGCAAAQVEFTDCKVPGRYLLGPENQGNSVFQRSMTWERACLPAIYLGAMEGQLAQCVDHARSRKQFGRSIGNFQAISHRLATMKLRLETSRLLLYRACWYLDQGRPAVEAAALAKTAVAEAAVANALDAVQVFGARGCLAADGIGQQLQNAIPLNIFSGTTEMQREVVAKSMGL

SEQ ID NO: 9785 - protein, 1230 aa, Cryptococcus neoformans var. neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 9786 - protein, 281 aa, Brassica oleracea
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGVSGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSNATN

SEQ ID NO: 9787 - protein, 362 aa, Streptomyces coelicolor A3(2)
MAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEAVGRPETYRQAFYARDLAGTVVLVGVPTPEMKLELPLLDVFGRGGSLKSSWYGDCLPSRDFPMLVDLHLQGRLDLGKFVTETIRLDEVEQAFDRMHAGDVLRSVVVL

SEQ ID NO: 9788 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 9789 - protein, 420 aa, Stigmatella aurantiaca
MDTHSKRHPSLPRPIQGEMKLENSNRLLAEAKRLIPGVTLSMMKRPEHFAPDAFPVYLARGQGALVEDVDGQQYIDFIGGLGANMLGHNHPAVVESIRKHLDEGLIHSLPTPVELSASQTLIEMIPGAEMARFFKTGADATSAAMRLARIITGKERIITVGYNGWHDHFMVGTPGVPAVMSQYTIRMPLFTPQDETALLACIGENAKQLAAVLISIPFNRCLSREFMHQLRAACTAHEVLMVQDEVITGFRLARGGAQEFFDVKADFVCLSKALAAGMPLSAVAGPAKHLSKLGAMEVQVSTTFGGEMLSLAVCEATLKEYRKGGYIEQLAALGSRLRTGINAKAEKAGSPLRVLGYDSIPFLLFDKNPTEHAKRMQPFQAGMARRGILLRRDVNFISAVHTQEQIDYTIEMAGEVLQSL

SEQ ID NO: 9790 - protein, 389 aa, Halobacterium salinarum
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCGGQGVVTQVRQTPLGRVQQRQECSRCGGEGELHSETCSTCGGQGQTRERATLTVDIPEGIRTGQTCAWTGEGATGEPERGDLLVDVTVEEHPDFERDGTTSITATPFSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 9791 - protein, 379 aa, Mannheimia haemolytica
MAKKDYYEVLGLSKGASEKDIKRAYKRLAAKHHPDKNQGSKESEEKFKEITEAYDVLTDSEKKAMYDQYGHAAFEQGGAGAGGFGGFGGGGFGGFEDIFSEMFGGGFGGGGRRQRVVRGDDLRYDIEITLEEAVKGCKKDIRIHTLAECDTCHGTGAEAGSKVETCSHCHGSGRIRRQQGFFVTDAVCPSCHGTGKRIEKPCRSCHGDGRVHKAKNLSVTIPAGVDTGNQLRLSREGAAGENGAPAGDLYVVIPVKEHDIFERDGSNLYCEVPIIFTLAALGGEIEMPTLDGQLKLKFRQKLQPVNYSVLRGKGVTSPRGGYAGDLICKVVVETPVNLTEEQKALLRQFEESLEGQGKHRPKHEGFFDGVKKFFDNLGK

SEQ ID NO: 9792 - protein, 379 aa, Streptomyces albus G
MATDYYAVLGVRRDASQDEIKKAFRRLARELHPDVNPDPKTQERFKEINAAYEVLSDPQKKQVYDLGGDPLSQNGGGGAGGFGQGGFGNFSDIMDAFFGTASQRGPRSRTRRGQDAMIRLDIELDEAAFGTTKDIQVDTAVVCNTCNGEGAAPGTSAQTCDMCRGRGEVSQVTRSFLGQVMTSRPCPQCQGFATVVPTPCPECAGDGRVPSRRTLTVKIPAGVDNGTRIQLAGEGEVGPGGGPGGDLYVEIHELPHSVFQRRGDDLHCTVTIPMTGPRPSAPRCLETLDGMEEIDIRPGTQSGQSVPLHGRGITHLRGGGGRDLIVHVEVTTPGKLDAEQEHLLRELAKLRGEERPTGQFQPGQQGLFSRLKDAFNGRS

SEQ ID NO: 9793 - protein, 376 aa, Deinococcus radiodurans
  misc_feature (78)..(78): Xaa can be any naturally occurring amino acid
MDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 9794 - protein, 475 aa, Sematophyllum subhumile subsp. japonicum
MSPQTETKAGVGFKAGVKDYRLNYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYSNATAGTSEEMLKRAQFARELGMPIIMHDYLTGGFTANTSLAHYARDNGLLLHIHRAMHAVIDRQKNHGMHFRVLAKALRLSGGDHVHAGTVVGKLEGERQTTLGFVDLLRDDYIEKDRSRGVYFTQDWVSLPGVLPVASGGIHVWHMPALTEIFGDDSVLQFGGGTLGHPWGNAPGAVANRVAVEACVQARNEGRDLAREGNEIIREATKWSPELAAACEVWKEIKFEFDTIDTL

SEQ ID NO: 9795 - protein, 325 aa, Vitis vinifera
GGGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 9796 - protein, 336 aa, Perilla frutescens
MYTGAIMHMAIPIKPAHYLHNSGRTYASQLCGFSSTSTRAAIARLPLCLRFRCSLQASDQRRSGNYSPSFWNADYILSLNSHYKDKSHMKRAGELIVQVKMVMGKETDPVVQLELIDDLQKLALSHHVEKEIKEILFKISTYDHKIMVERDLYSTALAFRLLRQYGFKVPQEVFDCFKNDNGEFKRSLSSDTKGLLQLYEASFLLTEGEMTLELAREFATKSLQEKLNEKTIDDDDDADTNLISCVRHSLDIPIHWRIQRPNASWWIDAYKRRSHMNPLVLELAKLDLNIFQAQFQQELKQDLGWWKNTCLAEKLPFVRDRLVECYFWCTGIIQPL

SEQ ID NO: 9797 - protein, 375 aa, Sinorhizobium meliloti
MDARAAVAIQAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIGPYLVNLTKRGADHIGGADYTFDCTGNTNVMRQALEASHRGWGKSVIIGVAGAGQKIATRPFQLVTGRTWMGTALGGARGRTDVPKIVDWYMEGKIAIDPMITHTMPLDDINKGFELMHSGESIRSVVLF

SEQ ID NO: 9798 - protein, 124 aa, Mycobacterium ulcerans
IQDGTKLGVEAKRYLDAGDLVPSDLTNQLVDDRLDQPDTAAGFILDGYPRSVEQAKALHEMLRRRDTDIDAVLEFRVSQDELLQRLKGRGRADDTDEVILNRMKVYRDETAPLLEFYDTEVKTV

SEQ ID NO: 9799 - protein, 155 aa, Staphylococcus haemolyticus
ELTTGPEIVEQFEGKQIDAFLAGVGTGGTLSGAGKVLKEKYPNIEIVAIEPEASPVLSGGEPGPHKLQGLGAGFVPDTLNTDIYDSIIQVGNDIAMETSRRVAKEEGILAGISSGAAIHAAIQKAKELGKGKTVLTVLPSNGERYLSTPLYSFDD

SEQ ID NO: 9800 - protein, 466 aa, Escherichia coli
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 9801 - protein, 479 aa, Streptomyces coelicolor A3(2)
MVTAAHRTASAPDAARTFPKGFLWGSATASYQVEGAAAEDGRTPSIWDTYARTPGRVRNGDTGDVATDHYHRRSEDVALMAELGLGAYRFSLAWPRIQPTGRGPAVQKGLDFYRRLVDELLEKGIQPVATLYHWDLPQELEDAGGWPERATAERFAEYAALAADALGDRVRTWTTLNEPWCSAFLGYGSGVHAPGRTDPVAALRAAHHLNLAHGLAVQALRERVRADAQVSVTLNIHHVRPLTGSEGDADAARRIDALANRVFTGPMLNGAYPEDLLKDTAELTDWSFVQDGDLRQAHQPLDFLGVNYYTPTVVSETDGSGAHTSDGHGNSSHSPWPGADRVAFHQPPGDTTAMGWAVDPTGLYDLLRRLSADFPRLPLVITENGAAFDDYADPEGQVNDPARIAYVRGHLAAVHQAILDGADVRGYFLWSLLDNFEWAHGYSKRFGAVYVDYPTGTRIPKASARWYSEVARTGVLPGA

SEQ ID NO: 9802 - protein, 357 aa, Streptomyces coelicolor A3(2)
MTSLFDSYRLGELTLPNRMVMAPMSRVRAAGGGLATPSMATYYAQRATAGLIVSEGVQPNEVGQSNPGTPGLHTDEQVAAWRPVTAAVHTNGGRIFAQIMHGGRVSHPDTTGMLPVGPSAVPAVGEVFTPTGPQPVPTPRALETAEVPEQARSYAEAARRAVDAGFDGVELHGANGYLISQFLSTNANLRTDRYGGPVAHRIRFAVEAVSATVEAVGADRTGIRLSPAGTFWGVEETDVLDLYTELLTELSRLGIAYVHIEATADEELLVALRRVWPGTLVMNPVLPMGPKQTGREDADHWLGLGADLISFGRGFIANPDLVERLRTGLPVAPVDESTYYQGGDAGYLTYPAYQHTV

SEQ ID NO: 9803 - protein, 459 aa, Orthodontium lineare
VKDYRLTYYTPDYQTKETDILAAFRMTPQPGVPAEEAGAAVAAESSTGTWTTVWTDGLTSLDRYKGRCYDIEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALYKSQAETGEIKGHYLNATAGTCEEMMKRAEFARELGAPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTI

SEQ ID NO: 9804 - protein, 180 aa, Oryza meyeriana
FGSVYRGRLKGKELAVKQLDRNGMQGTREFLVEVLMLSLLEHPNLVTLLGYCTDADHRILVYEYMPRGSLEDHLLDLPPGASSLDWTTRMRVAQGAARGLEHLHDAARPPVIYRDFKASNILLDRSFQARLSDFGLAKVGPVGDKTHVSTRVMGTYGYCAPEYALTGKLTTCSDVYSFGI

SEQ ID NO: 9805 - protein, 244 aa, Corynebacterium glutamicum
DHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 9806 - protein, 322 aa, Leptolyngbya boryana
MAQDQKPTVVITGASSGVGLYAAKALVKRGWHVVMACRNLEKADSAAKSLGMSPDSYTLMHIDLGSLDSVRKFVTQFRESGKSLDALVCNAAVHMPLLKEPMRSPEGYELSVATNHFGHFLLCNLLLEDLKHSTHNDPRLIILGTVTANSKELGGKIPIPAPADLGDLSGLEAGFKAPIAMIDGKPFKAGKAYKDSKLCNMITSRELHRRYHDSTGIVFNTLYPGCVADTPLFRNSLPVFQKVFPWFQKNITGGYVSQELAGERTAQVVADPEFKQSGVHWSWGNRQKEGRESFVQELSEKVTDDAKAKRMWELSEKLVGLA

SEQ ID NO: 9807 - protein, 508 aa, Schizosaccharomyces pombe
PTHNQTFINHTTKRRIMSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDESTDVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 9808 - protein, 509 aa, Bacillus cereus
MWESKFVKEGLTFDDVLLVPARSDILPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLEEAEKILQKYKIEKLPLVDNNGVLQGLITIKDIEKVIEFPNSAKDKQGRLLVGAAVGVTADAYLRIDALVKASVDAIVLDTAHGHSKGVIDKVKEVRAKYPSLNIIAGNVATAEATKALIEAGENVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLRESHPHHVQITKEAPTTHYNVLYTNRQRFDISVYFFLIMLE

SEQ ID NO: 9809 - protein, 334 aa, Schizosaccharomyces pombe
MTLSGKPAALLVGTLKHAHKEWEALGKYAELKTYSDGTREDFLAKCKTEFQNVKAICRTYNSKFYMGIWDKEIIDNLPPSVKFICHLGAGYETVDVAACTARGIQVSHVPKAVDDATADVGIFLMLGALRGFNQGIFELHKNNWNANCKPSHDPEGKTLGILGLGGIGKTMAKRARAFDMKIVYHNRTPLPEEEAEGAEFVSFDDLLAKSDVLSLNLPLNAHTRHIIGKPEFQKMKRGIVIVNTARGAVMDEAALVEALDEGIVYSAGLDVFEEEPKIHPGLLENEKVILLPHLGTNSLETQYKMECAVLMNVKNGIVNDSLPNLVPEQRGDIE

SEQ ID NO: 9810 - protein, 175 aa, Clostridium histolyticum
MEDKKRNILIGKEEIASKIQEIGAIISKDYEGKNLYVLSLLRGSFIFTADLVRELQVKTKIGFMTTSSYGNSENSSGTVKVVNDVPDNIEGFDVLIVDDIMDTGITMEFVVKHLKELGANSVNTCVLLDKPERRVAKIKPDYTCFEIPDLFVVGYGLNYGDYYRNIPYIFNWENN

SEQ ID NO: 9811 - protein, 445 aa, Acinetobacter baumannii
MSVTSVNPATNATNEYYLTRQSQMESNVRSYPRKLPLAIAKAQGCWVTDVEGTQYLDCLAGAGTLALGHNHPAVIQSIQDTLASGLPLHTLDLTTPLKDAFTEALLAYLPGGKEEYCLQFCGPSGADATEAAIKLAKTYTGRSSVISFSGGYHGMTHGSLAMTGNLSAKNAVNGLMPGVQFMPYPHEYRCPLGLGGEAGVDALTYYFENFIEDVESGVTKPAAVILEAIQGEGGVVTAPVKWLQKIREVTEKHNIVLILDEVQAGFARSGKMFAFEHAGIEPDVVVMSKAVGGGLPLAVLGIKRKFDAWQPAGHTGTFRGNQLAMGTGLVVLETIKEQNLAQNAQERGEFPCIGNVRGRGLMIGVEIVDERKPADRIGSHPADSQLAAAIQTACFNNNLLLEKGGRNGTVIRLLCPLIITQEECVEVIARFKKAVAEALVAVRGA

SEQ ID NO: 9812 - protein, 509 aa, Helianthus annuus
MSTTIKTSLLALFLLFILSPTAFSSTKGGLLRVGLKKRKTNQFNRVSEHGLSMEGTDRRNFGFYDTLRNSEGDVIVLKNYMDAQYFGEIGIGTPPQKFTVVFDTGSANLWVPSSKCFLSVACLFHQKYKASRSSTYKKNGTAAAIQYGTGAISGVFSRDSVKLGDLVVKEQDFIEATREPGITFLAAKFDGILGLGYQDISVGKAVPVWYNMVNQGLVQEPVFSFWFNRHTGEEEGGELVFGGVDPNHFKGKHTYVPVTQKGYWQFDMGDVLIGDKTTGFCSGGCAAIADSGTSLLAGPTTIITQINHAIGAAGVMSQQCKTLVDQYGKTIIEMLLSEAQPDKICSRMNLCTFDGSRDVSSIIESVVDKNNGKSSAGLNDGICAFCEMAVVWMQSQLKRNQTEDSIINYVNELCDRIPSPMGESAVDCQTLSNMPNIAFTIGGKTFDLTPEQYILKVGEGEVAQCISGFTALDVAPPHGPLWIHGDVFMGQYHTVFDFGKSRVGFAEAA

SEQ ID NO: 9813 - protein, 317 aa, Lactococcus lactis subsp. cremoris
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQLIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTEAYDRVINVTSDEALETARKIGKNEGFLVGISSGAQFGQLMNWQKNLAKIKKFWLFVLTMVSVIFQQNSMIIKTWNFPSFFVL

SEQ ID NO: 9814 - protein, 146 aa, Schizosaccharomyces pombe
FIDGKCDAIGEGDVIWLETPLNPLGIAFDIPFYKELAKKKGAILVVDSTFAPPPIQDALVLGADYVVHSATKYLAGHSDVLAGVTASKDRSKILDLKADRAYLGTILHPQQAFLLLRSLRTFPLRIAEHSENGFLVALHLNKLATD

SEQ ID NO: 9815 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVNKSA

SEQ ID NO: 9816 - protein, 465 aa, Vibrio cholerae
MKICPVVLSGGVGSRLWPLSREHFPKQCLNLTDLLSSLLQQTLVRTNHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPTRAETGYGYIKAGQDSCVEKFVEKPDLATAQSYLESGDYLWNSGMFLFQASQYLAELKQHRPAMYAAVESAYGNRTEDLDFIRIGTEAFTACPSESIDYAIMEPTQNAKVVPYNGDWSDIGAWDALHDYCEKDSNHNVLVGDVMAESTTNSLVRAESRLVATIGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFSDRYGR

SEQ ID NO: 9817 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEREFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 9818 - protein, 466 aa, Arthrobacter sp.
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 9819 - protein, 371 aa, Schizosaccharomyces pombe
AQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDADNFGCTFGGLFVLEFLGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFGHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 9820 - protein, 376 aa, Schizosaccharomyces pombe
IMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHHHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSMVVGATNFVFTIVAFMFIDRIGRRRILLCTSAVMIAGLALCAIAYHFLPADTTQNTHSGWQYVVIASIIIFLASYASGIGNIPWQQAELFPMEVRALGAGFSTAINWVGNLIISASFLTMMESITPTGTFALFAGFCFVGLVTSYFTYPELAGMFIENIHKLLEKGFWQA

SEQ ID NO: 9821 - protein, 233 aa, Plesiomonas shigelloides
MFKPFSAEFFGTFWLVLGGCGSALISAAFPQLGIGFLGVALAFGLTVVTMAYAVGHISGAHFNPAVTLGLWAGGRFPAARVLPYIIAQVIGGIAAAAVLYGIASGKAGFDATTSGFAANGYGIHSPGGYALSACMLSEFVLSAFFVIVIHGATEKRAPAGFAPLAIGLTLTIIHLVSIPVTNTSVNPARSIAAAVFQGTWALDQLWMFCLIPSLGGIAGGLIYRALLARPAEA

SEQ ID NO: 9822 - protein, 153 aa, Bacillus halodurans
KLAGTERGVTSPEATFSTCFGAPFLPLPAARYAEMLGEKIAQYEVQVFLVNTGWSGGPYGVGQRMKLSYTRAMVQAALQGELNTVETITDSVFGLHIPTRCPGVPDFVLQPRNTWDDKEKYDKKAQELAKQFIENFKRFTNVSEAIQKAGPSI

SEQ ID NO: 9823 - protein, 388 aa, Schizosaccharomyces pombe
DLTISQAIFELSSPFLENKSPKALDTLFSAIRDHDLAPLYKYLSENPKTSASIDFDSNFLNSMIKKNEEKLAEFDKAIEDAQELNGEHEILEAMKNKADYYTNICDRERGVQFCDETFERATLTGMKIDVLFSKIRLAYVYADMRVVGQLLEKLKPLIEKGGDWERKNRLKAYQGIYLMSIRNFSGAANLLLDCMSTFSSTELLPYYDVVRYAVISGAISLDRVDVKTKIVDSPEVLAVLPQNESMSSLEACINSLYLCDYSGFFRTLADVEVNHLKCDQFLVAHYRYYVREMRRRAYAQLLESYRALSIDSMAASFGVSVDYIDRDLASFIPDNKLNCVIDRVNGVVFTNRPDEKNRQYQEVVKQGDVLLNKLQKYQATVMRGAFKV

SEQ ID NO: 9824 - protein, 369 aa, Sulfolobus acidocaldarius
MEKVNYDVKGGDPYSILFTSGTTGKPTVMYTHEKVIHGALSIVHQLGLYNSPAKLSSNDVIMPFIPIYHLWSWGSAFIASYLGAKYVLTGKFDPKTAIQLIKRENATWINAVPTMIQMILSSGEQLPGVKALIGGQAIPYNVAKSISDAGLKFSTIYGGTDMLAISISIIPGKFQVNDDIDYLRTTTHPVPFVEVKVIKPDGTEASYNEIGELYVRAPWLPGSYYNNPEETQRAYDENGWFKTGDLAIITEEGGLRIVDRLKDVIKSGGEWIPSSVLESIISEIPAVEQVAVLGYPDQKWGERPMAVVKLKPGQRTDQKEILEYLRDAVNKGRINKWWLPDKIVFVDNMPLTSTGKINKLALRKDVGIG

SEQ ID NO: 9825 - protein, 1287 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPATEPTTPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHEHLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRNPAYRTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRKESVENSSKENISATPDRQAELPNTGIKNENKLLFAGISLLALLGLGFLLKNKKEN

SEQ ID NO: 9826 - protein, 374 aa, Gibberella circinata
MVRNIALAALLPAAWALPSSSLQERDACTVTDYSGLATAVSSCTNIVLKGFQVPTGKQLDLFKLKAGTTVTFKGTTTFATTADNDFNPIVISGSGITITGASGHVIDGNGQAYWDGQGSNNADNPKPDHFIVVKKVTGTSKITNLNIQNWPVHCFDITGSSDLTISGLILDNRAGDKPNSKSGGLPAAHNSDGFDISSCDHVTLDNNHVYNQDDCVAVTSGTNIVVSNMYCSGGHGLSIGSVGGKSTNVVNGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPTNTCPS

SEQ ID NO: 9827 - protein, 434 aa, Streptomyces coelicolor A3(2) [sequence omitted]

SEQ ID NO: 9828 - protein, 475 aa, Aristotelia chilensis
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9829 - protein, 475 aa, Aristotelia serrata
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYITGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9830 - protein, 475 aa, Psychrophila novae-zealandiae
MSPQTETKASVGFKAGVKDYKLTYYTPEYTPKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSLELAAACEVWKEIKFEFEAMDTL

SEQ ID NO: 9831 - protein, 466 aa, Caltha appendiculata
SVGFKAGVKDYKLTYYTPEYTPKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSLELAAACEVWKEIKFEFEAMDTL

SEQ ID NO: 9832 - protein, 475 aa, Discaria chacaye
MSPQTETKASVGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIKFEFEAMDTL

SEQ ID NO: 9833 - protein, 475 aa, Discaria toumatou
MSPQTETKASVGFKAGVKDYKLTYYTPDYETKDTDILAAFRVTPQPGVPPEEAGAAVAAESSTGTWTTVWTDGLTSLDRYKGRCYHLEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIKFEFEAMDTL

SEQ ID NO: 9834 - protein, 472 aa, Griselinia littoralis
TETKASVGFKAGVKDYRLPYYTPDYEPKDTDILAAFRVTPQPGVPPEEAGAAVAAESSTGTWTTVWTDGLTSLDRYKGRCYKIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVKQDRSRGIYFTQDWVSLPGVLPVASGGIHVWHMPALTEIFGDDSVLQFGGGTLGHPWGNAPGAVANRVALEACVQARNEGRDLASQGNEIIREATKWSPELAAACEVWKEIKFEFAAMDTLD

SEQ ID NO: 9835 - protein, 475 aa, Gunnera lobata
  misc_feature (11)..(11): Xaa can be any naturally occurring amino acid
MSPQTETKAGXGFKAGVKDYKLTYYTPDYETKDTDILAAFRMTPQPGVPPEEAGAAVAAESSTGTWTTVWTDGLTNLDRYKGRCYGIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 9836 - protein, 476 aa, Luzuriaga parviflora
MSPQTETKASVGFKAGVKDYKLTYYTPDYETKDTDILAAFRVTPQPGVPPEEAGAAVAAESSTGTWTTVWTDGLTSLDRYKGRCYHIESVAGEENQFIAYIAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFEPVDKLD

SEQ ID NO: 9837 - protein, 473 aa, Podocarpus totara
PQTETKASAGFKAGVKDYRLTYYTPEYQTKDTDILAAFRVTPQPGVPPEEAGAAVAAESSTGTWTTVWTDGLTSLDRYKGRCYDIEPVPGEENQFIVYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFCFCAEALFKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREVTLGFVDLLRDDFIEKDRSRGIYFTQDWVSMPGVLPVASGGIHVWHMPALTEIFGDDSVLQFGGGTLGHPWGNAPGAVANRVALEACVEARNEGRDLAREGNEVIREASKWSPELAAACEVWKEIIFEFETIDTL

SEQ ID NO: 9838 - protein, 475 aa, Weinmannia racemosa
MSPQPETKASVGFKAGVKDYKLTYYTPDYETKDTDILAAFRVSPQPGVPPEEAGAAVAAESSTGTWTSVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 9839 - protein, 263 aa, Antithamnion sp.
MNIISESLRSHPNSCALIPFITAGYPDINTTIQALYELDSQGADIIELGIPYSDALADGSVIQHSSLIALQGGTYIDQVLHILEVVSTKLNTPIIILPYYNPILKRGIEKFIKQISLMGAKGLIVPDLPLEETDELIVICNDNQIELVLFVAPTSSMKRINSISKKSPGCIYLVSSTGVTGVRDDIDIKVMELSNYIKKVSNKFIMLGFGISTPEHIKKIMKWNIDGVVVGSAFVKKLSALKIDDRISSISSLCKSLKKATIL

SEQ ID NO: 9840 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELGPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 9841 - protein, 475 aa, Bacillus flavocaldarius
MAWYEGAFFYQIFPDRFFRAGPPGRPAPAGPFEPWEDPPTLRGFKGGTLWGVAEKLPYLLDLGVEAIYLNPVFASTANHRYHTVDYFQVDPILGGNEALRYLLEVAHAHGVRVILDGVFNHTGRGFFAFQHLMENGEQSPYRDWYHVKGFPLKAYTAHPNYEAWWGNPELPKLKVETPAVREYLLAVAEHWIRFGVDGWRLDVPNEIPDPTFWREFRQRVKGANPEAYIVGEIWEEADFWLQGDMFDAVMNYPLARAVLGFVGGEALDRDLAAQTGLGRIEPLQALAFSHRLEDLFGRYRPEVVRAQMNLLTSHDTPRLLSLMRGSVERARLALALLFLLPGNPTVYYGEEVGMAGGKDPENRGGMVWEEARWQKDLRETVKRLARLRKEHPALRTAPYLRIYAQDGHLAFARGPYLVVVNASPHPFRQDFPLHGVFPRGGRAVDLLSGEVCTPQGGRLCGPVLPPFSLALWREA

SEQ ID NO: 9842 - protein, 421 aa, Pseudomonas fluorescens
MRAQVQQGLVLGMSTLAFTVCFMVWMMFAVLGVPIKELLALNETQFGLLAATPVLTGSLVRLPLGLLTDRFGGRIVFFLLMLACVLPLYLITLATAYWQFLVLGLFVGLAGGSFSVGIAYVAKWFDKQNQGFAMGVFGAGNAGAAVTKFLAPALIAFGTWHLVPKVFSAILFITALLFWFLTAEKKEHRNAGGATLREQLKSLKDPAVWRYCQYYSIVFGGYVALALWMTKYYVQEYGFSLQSAALLAACFSLPGGVLRAVGGWMSDRWGAQSVTWWVLWVSWICLFLLSYPQTQLQVQTVNGIVDFHIGLNATLFPVILFVMGIAFAFGKASVFKYIANNYPQNMGAVSGIVGLAGGLGGFVLPIMFGALVDLTGVRSSCFMLLYGVVWVSLIWMYLSKVHKRPLLGKQPPASQSPFSSI

SEQ ID NO: 9843 - protein, 394 aa, Penicillium janthinellum
MVSFTQLQLAFLGLSALGAAVPVTGTSEKKTFSLNQVKVAGTKTKNPAEHYANALRKYGAEVPSHVLAAAAATGSVTTSPTEFDSEYLTPIDVGGTTMNLDIDTGSSDLWVFSKELPSSETSGHAVYSPSSQSQLLNGYSWSISYGDGSSASGNVYLDYVTVGGVTASSQAVEAAETISSEFQQDPSDGLMGLAFSSINTVQPESQSTFFDNVQSNLASPVFCADLKYEAPGVYDFGFIDSSKHTGSVTYTPVDNSQGFWGFTASGYAVGSGSTVSTSISGIADTGTTLLLLPSSIVKKYYAQVKGSSNSATYGGYVFPCSATLPKFTVVINGYKAVIAAQYLNYSPVETGSSTCFGGIQSDTGIGFSIFGDIFLKSQYVVFDASGPRLGFAPQ

SEQ ID NO: 9844 - protein, 302 aa, Arabidopsis thaliana
MPRYDDRYGNTRLYVGRLSSRTRTRDLERLFSRYGRGYIPKVSGGLPNLEMFDEWVDCGVIGGNSRLEFSDPRDADDARYYLDGRDFDGSRITVEASRGAPRGSRDNGSRGPPPGSGRCFNCGVDGHWARDCTAGDWKNKCYRCGERGHIERNCKNSPSPKKARQGGSYSRSPVKSRSPRRRRSPSRSRSYSRGRSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 9845 - protein, 341 aa, Mycoplana ramosa
MRVIFSEDHKLRNAKTELYGGELVPPFEAPFRAEWILAAVKEAGFDDVVAPARHGLETVLKVHDAGYLNFLETAWDRWKAAGYKGEAIATSFPVRRTSPRIPTDIEGQIGYYCNAAETAISPGTWEAALSSMASAIDGADLIAAGHKAAFSLCRPPGHHAGIDMFGGYCFINNAAVAAQRLLDKGAKKIAILDVDFHHGNGTQDIFYERGDVFFASLHGDPAEAFPHFLGYAEETGKGAGAGTTANYPMGRGTPYSVWGEALTDSLKRIAAFGAEAIVVSLGVDTFEQDPISFFKLTSPDYITMGRTIAASGVPLLVVMEGGYGVPEIGLNVANVLKGVAG

SEQ ID NO: 9846 - protein, 444 aa, Pseudomonas abietaniphila
EFLRHQIADTGTHLVICEADYLSRISAIADQLTDVHRVLYRNASGQQVTSPSAPFPIESLDAHRGSDDSAFERKPQPSDLACLIYTSGTTGPSKGCMISYNFMCNLARLQLRAGPASEDDVTITPLPLFHMNALCVSIIASILVGARAAILPRFSVSNFWPEVERSGATIASILGGMGGLLAQAPDNEAMLRCRGQIHTARGNPYTEETKQIWRERFGTRLVGGNGYGLTEACVVTSLAAGEYAAPGSSGKRIADFDVRIVDEQDNEVPGGTPGEIVVRPQRPDIMFQGYWRRPEDTQKLMRNMWFHTGDVGKFDDEGFFYFVDRKKDYLRRRGENISSFEMEAAFATHPALSEVAVHAVPSDKGEDDVKVTAVLHENTELAPEALFHWAADTVPYYALPRYIEFRTSLPKNPQGRVLKYLLRDEGKTATTWDLDDTDIKVAKR

SEQ ID NO: 9847 - protein, 1196 aa, Paenibacillus polymyxa
MTLYRSLWKKGCMLLLSLVLSLTAFIGSPSNTASAAVADDFQASVMGPLAKINDWGSFKKQLQTLKNNGVYAITTDVWWGYVESAGDNQFDWSYYKTYANAVKEAGLKWVPIISTHKCGGNVGDDCNIPLPSWLSSKGSADEMQFKDESGYANSEALSPLWSGTGKQYDELYASFAENFAGYKSIIPKIYLSGGPSGELRYPSYYPAAGWSYPGRGKFQAYTETAKNAFRTAMNDKYGSLDKINAAWGTKLTSLSQINPPTDGDGFYTNGGYNSAYGKDFLSWYQSVLEKHLGVIGAAAHKNFDSVFGVRIGAKISGLHWQMNNPAMPHGTEQAGGYYDYNRLIQKFKDADLDLTFTCLEMSDSGTAPNYSLPSTLVDTVSSIANAKGVRLNGENALPTGGSGFQKIEEKITKFGYHGFTLLRINNLVNNDGSPTGELSGFKQYIISKAKPDNNGGTGNKVTIYYKKGFNSPYIHYRPAGGSWTAAPGVKMQDAEISGYAKITVDIGSASQLEAAFNDGNNNWDSNNTKNYSFSTGTSTYTPGNSGNAGTITSGAPAGANPGDGGGTTNKVTVYYKKGFNSPYIHYRPAGGSWTAAPGVKMQDAEISGYAKITVDIGSASQLEAAFNDGNNNWDSNNTKNYLFSTGTSTYTPGSNGAAGTIRTGAPSGSVLSVVTSTYATDLNEVTGPIQTEKLSGVSLNVSTSTYAPNSNGVEVTAQTEAPSGAFTSMDLGTLSNPTSLNTDWSKQSIYFIMTDRFSNGDPSNDNYGGFNSNNSDQRKWHGGDFQGIINKLDYIKNMGFTAIWITPVTMQKSEYAYHGYHTYDFYAVDGHLGTMDKLQELVRKAHDKNIAVMVDVVVNHTGDFQPGNGFAKAPFDKADWYHHNGDITDGDYNSNNQWKIENGDVAGLDDLNHENPATANELKNWIKWLLNETGIDGLRLDTVKHVPKGFLKDFDQAANTFTMGEIFHGDPAYVGDYTRYLDAALDFPMYYTIKDVFGHDQSMRKIKDRYSDDRYYRDAQTNGVFIDNHDVKRFLNDASGKPGANYDKWPQLKAALGFTLTSRGIPIIYQGTEQGYSGGDDPANRENMNFNANHDLYQYIAKLNYVRNNHPALQNGSQREKWVDDSFYSFQRSKNGDEAIVFINNSWNSQTRTIGNFDNLSNGTRLTNQLSNDSVQINNGSITVTLAPKEVKVFTK

SEQ ID NO: 9848 - protein, 333 aa, Schizosaccharomyces pombe
MPIVSGFKVGPIGFGLMGLTWKPKQTPDEEAFEVMNYALSQGSNYWDAGEFYGVDPPTSNLDLLARYFEKYPENANKVFLSVKGGLDFKTLFLVGNRTSFPRSVENVIAHLRGTQKLDLFQCARVDPNVPIETTMKTLKGFVDSGKISCVGLSEVSAETIKRAHAVVPIAAVEVEYSLFSRDIETNGIMDICRKLSIPIIAYSPFCRGLLTGRIKTVEDLKEFAKSFPFLEYLDRFSPDVFAKNLPFLQAVEQLAKKFGMTMPEFSLLFIMASGNGLVIPIPGSTSVSRTKSNLNALNKSLSPEQFKEAKEVLSKYPIYGLRYNEQLAGTLSV

SEQ ID NO: 9849 - protein, 178 aa, Buchnera aphidicola (Acyrthosiphon pisum)
  misc_feature (167)..(167): Xaa can be any naturally occurring amino acid
MKHTLQVIITEKELDIRVRELGQEITKKYRNSRNKMILIALLRGSFIFISDLCRRIHIEHEIDFMTTSSYGRGMLSSGDVKIIKDLDEDIYNKNVLIVEDIIDSGKTLSKVLDILKLRNPKSLSICTLLDKPECREVNINVDFIGFSILENFFIVGYGIDYAQSYRXLPNIGKVVFKK

SEQ ID NO: 9850 - protein, 465 aa, Erwinia chrysanthemi
MSNPFPAHFLWGGAIAANQVEGAYLTDGKGLSTSDLQPQGIFGEIVTRQPGDSGIKDVAIDFYHRYPQDIALFAEMGFTCLRISIAWTRIFPQGDEAEPNEAGLAFYDRLFDELAKYGIQPLVTLSHYEMPYGLVEKHGGWGNRLTIDCFERYARTVFARYRHKVKRWLTFNEINMSLHAPFTGVGLPPDSDKAAIYQAIHHQLVASARAVKACHDMIPDAQIGNMLLGAMLYPLTSKPEDVMESLHQNREWLFFGDVQVRGAYPGYMHRYFREQGITLNITAQDKQDLKATVDFISFSYYMTGCVTTDEAQLEKTRGNILNMVPNPYLESSEWGWQIDPLGLRYLLNFLYDRYQKPLFIVENGLGAKDKIEENGDIYDDYRIRYLNDHLVQVGEAIDDGVEVLGYTCWGPIDLVSASKAEMSKRYGFIYVDRDDAGHGSLERRRKKSFYWYQSVIASHGKTLTR

SEQ ID NO: 9851 - protein, 503 aa, Avicennia marina
MSTMAIRMPTRQLFIDGEWREPVQRKRILIINPANEQTIGDIPAATAEDVDIAVEAARKAFFRNSGKDWSSTTGAHRAKYLRAIAAKIKDRKAELVKLEAIDSGKPLVEASLDMDDVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIAATFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAIDLANDTHYGLAAAVISKDLDRCERMAKAFQVGAVWVNCSQPCFYQAPWGGKKRSGFGRELGERGLDIYLNVKQVTQYVSSEPWDWYKSP

SEQ ID NO: 9852 - protein, 502 aa, Avicennia marina
  misc_feature (158)..(158): Xaa can be any naturally occurring amino acid
MAIRIPSRQLFIDGKWREPVNRKRLPIVNPATEETIGDIPAATAEDVNIAVEAARKAFFHNGGKDWATASGAHRAKYLRAIAAKVTEKKEELAKLEVLDCGKPLEEAAWDMDDVAGCFEYFADLAERLDSNQIPVSLPMDTFKCHVLKEPIGVVGLVXPWNYPLLMATWKVAPALAAGCTAILKPSEIASVTCLELAQVCKEVGLPAGVLNILTGLGPEAGAPLASHPHVDKITFTGSGATGSKIMTAAAQLVKPVTLELGGKSPIVVFEDVDLDTAAEWTLFGCFWTNGQICSATSRLLVHESIATTFLEKLVKWCEKIKISDPLEEGCRLGPIISRGQYEKVMKFISTAKEEGATILCGGARPEHLEKGYFVQPTIITDVKTSMQIWIEEVFGPVLGVKTFSKEDEPFELANDPHYGWAAAVLSQDLERCERMTKAFQAGIVWVNCSQPCFCQAPWGGKKRSGFGRDLGEWGLDNYLNVKQVTRYVSSEPWDWYKSPSKL

SEQ ID NO: 9853 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLSLGEINKAFDLLHEGTCLRCVLDTSK

SEQ ID NO: 9854 - protein, 327 aa, Eucalyptus gunnii
MSAAGGAGKVVCVTGASRYIASWLVKLLLQRGYTVKASVRDPNDPKKTEHLLGLDGAKDRLQLFKANLLEEGSFDPIVEGCAGVFHTASPFYHDVKDPQAELLDPAVKGTLNVLKSCSKAPSLQRVVLTSSMAAVAYNRQPRTPEVVVDESWFSDPDLCRQTNAWYVLSKTLAEDAAWKFVKEKGIDMVTINPAMVIGPLLQPTLNTSAAAIGNLINGAPTFPNASFGWVNVKDVANAHILAFEVPSASGRYCLVERIAHYSEIVRILRELYPSAQLPEKSADDKPFVPIYQVSKEKVKSLGINYIPLEQNLKETVESLKEKGFVKF

SEQ ID NO: 9855 - protein, 281 aa, Saccharomyces cerevisiae
MAQNNFDFKFSQCFGDKADIVVTEADLITAVEFDYTGNYLATGDKGGRVVLFERSNSRHCEYKFLTEFQSHDAEFDYLKSLEIEEKINEIKWLRPTQRSHFLLSTNDKTIKLWKVYEKNIKLVSQNNLTEGVTFAKKGKPDNHNSRGGSVRAVLSLQSLKLPQLSQHDKIIAATPKRIYSNAHTYHINSISLNSDQETFLSADDLRINLWNLDIPDQSFNIVDIKPTNMEELTEVITSAEFHPQECNLFMYSSSKGTIKLCDMRQNSLCDNKTKTFEEYLD

SEQ ID NO: 9856 - protein, 100 aa, Serratia marcescens
VLTTGHGEVRADKLLVATGRTPNTRSLALDAAGVTVNAQGAIVIDKGMRTSTPHIYAAGDCTDQPQFVYVAAAAGTRAAINMTGGDAAINLTAMPAVVFT

SEQ ID NO: 9857 - protein, 468 aa, Escherichia coli
MSKQQIGVVGMAVMGRNLAPNIESRGYTVSIFNRSREKTEEVIAENPGKKLVPYYTVKEFVESLETPRRILLMVKAGAGTDAAIDSLKPYLDKGDIIIDSGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 9858 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRVDKEGVFHTEWLD

SEQ ID NO: 9859 - protein, 468 aa, Escherichia coli
MSKQQIGVVGMAVMGRNLALNIESRGYTVSIFNRPREKTEEVIAENPGKKLVPYYTVKEFVESLETPRRILLMVKAGAGTDAAIDSLRPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEFNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 9860 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEGGALKGPSIMPGGQKEAYELVAPILTKIAAVAEDGEPCVTYIGADGAGHYVEMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 9861 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFLDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 9862 - protein, 468 aa, Escherichia coli
MSKQQIGVIGMAVMGRNLALSIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 9863 - protein, 186 aa, Cyanophora paradoxa
MRKLFLLMFCLSGLILTTDIRPVRADVAGLIPCSQSDAFERRLKNTTQRLENRLKKYEPGSAPAEALQKQIDKTQQRFDKYRNSGLLCGADGLPHLITDGRWSHAGEFTIPGLLFLYIAGFIGWSGRSYLQAVAASDNSTEKEIIIDIPVALQSVSKGFVWPLAALQEFSSGKLTARDEEITISPR

SEQ ID NO: 9864 - protein, 173 aa, Cyanophora paradoxa
MPRSQRNDNFIDKTFTVIADLILKILPVSKKTKEAFAYYRDGMSAQSEGAYAEALENYYEALRLEEDPYDKSYTFYNIALIHTSNGDQTKALEYYRQALDLNPKMPQALNNMAVIYHAQGEQAAEQGDMEMAEALFDQAAFYWKQAIRLAPDNYIEAQNWLKTTGRSKLDILI

SEQ ID NO: 9865 - protein, 475 aa, Cyanophora paradoxa
MSSQARTQTRAGFKAGVKDYRLTYYTPEYTPKETDILAAFRMTPQPGVPPEECAAAVAAESSTGTWTTVWTDGLTSLDRYKGRSYGFEPVPGEENQYICYVAYPLDLFEEGSVTNMLTSIVGNVFGFKALRALRLEDLRIPVGYSKTFQGPPHGITVERDKLNKYGRALLGCTIKPKLGLSAKNYGRAVYECLRGGLDFTKDDENVNSQPFMRWRDRFLYVMDAIKKSQAETGEIKGHYLNATAPTTEEMIKRAEFAAELDAPIIMHDYITAGFTSNTTLARWCRDNGPLLHIHRAMHAVIDRQKNHGIHFRVLAKTLRMSGGDHLHSGTVVGKLEGDRAGTLGFVDLMRDDHIEQDRSRGIFFTQDWASMPGVMPVASGGIHIWHMPALVDIFGDDSCLQFGGGTLGHPWGNAPGAVANRVALEACVQARNEGRNLAREGNEIIREAARFSPELAAACEVWKEIKFEFETIDTI

SEQ ID NO: 9866 - protein, 448 aa, Pseudomonas putida
MNQAQNSVGKSLDVQSFINQQPLSRYQWRVVLLCFLIVFLDGLDTAAMGFIAPALSQEWGIDRASLGPVMSAALIGMVFGALGSGPLADRFGRKGVLVGAVLVFGGFSLASAYATNVDQLLVLRFLTGLGLGAGMPNATTLLSEYTPERLKSLLVTSMFCGFNLGMAGGGFISAKMIPAYGWHSLLVIGGVLPLLLALVLMVWLPESARFLVVRNRGTDKIRKTLSPIAPQVVAEAGSFSVPEQKAVAARSVFAVIFSGTYGLGTMLLWLTYFMGLVIVYLLTSWLPTLMRDSGASMEQAAFIGALFQFGGVLSAVGVGWAMDRYNPHKVIGIFYLLAGVFAYAVGQSLGNITVLATLVLIAGMCVNGAQSAMPSLAARFYPTQGRATGVSWMLGIGRFGAILGAWSGATLLGLGWNFEQVLTALLVPAALATVGVIVKGLVSHADAT

SEQ ID NO: 9867 - protein, 323 aa, Streptomyces coelicolor A3(2)
MDTRPLVSTPFTASSTADEVLEDVDLTGVRAIVTGASSGLGIETARALTAAGAEVTLAVRNTAAGASAAETIARSTGAAPPRVVRLDLADRAGVTRFVDAWDGPLHLLVNNAGVVTGGLERTPEGWELHFATNHLGHFALATGLHQALARGAAERGGARIVSVSSTAHMRSGIDFDDLHFERRSHDPQTAYAQSKTANSLFAVEATRRWGSAGIVANAVNPGGVATGLQRNFTPEQKASLDAAEAAGVFTYKTVEQGAATSVVAAVAPEFAHSGGHYLDDGQEAYTVPNDADLAQHPHGVKEWALDPAAAKRLWTVSTDLLRS

SEQ ID NO: 9868 - protein, 367 aa, Emericella nidulans
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQRIASAYPGLFIQKHVHVTGSAVGNRNEAIETMEFAARGVIKAHFREEKMEALTEIFKEMEEGKLQGRVVLDLS

SEQ ID NO: 9869 - protein, 479 aa, Pseudoalteromonas haloplanktis
MSTNSCCSSDNSQPEQLHVAIIGSGSGAFASAIKAAEGGARVTIIEGADVIGGCCVNVGCVPSKILIRAAQLAHQQRTNPFDGLENIQPQLSRSLLAHQQTARVEELRGAKYQSILENNPALSLLKGYARFKNENTLLVQMADGSEEELVADRILIATGSTPSIPPIDGLVDTPYWTSTEALFSDVLPSSLVVIGSSVIALEIAQAYARLGSSVTVLARHTLLYAEDPLLGEKLTECFEKEGIRVLNNTQANHVSYSNNGFPLETNEGTLTAEKLLISTGRHANTDKLGLENVGVETDKSGAIVVNSMMETSTANIYAAGDCSNMPQFVYVAAAAGSRAGINMTGGNAQLDLSTMPAVIFTDPQVATVGLTEEQAITGGFEVISRVLDMENVPRALANFETDGFIKLVADKSTGKILGAQILAHEGGELIQSAALAIHNKMTVEELAGQLFPYLTMVEGLKLCAQTFSKDVKELSCCAG

SEQ ID NO: 9870 - protein, 459 aa, Agrobacterium sp. ATCC 21400
MTDPNTLAARFPGDFLFGVATASFQIEGSTKADGRKPSIWDAFCNMPGHVFGRHNGDIACDHYNRWEEDLDLIKEMGVEAYRFSLAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGVHAPGERNMEAALAAMHHINLAHGFGVEASRHVAPKVPVGLVLNAHSAIPASDGEADLKAAERAFQFHNGAFFDPVFKGEYPAEMMEALGDRMPVVEAEDLGIISQKLDWWGLNYYTPMRVADDATPGVEFPATMPAPAVSDVKTDIGWEVYAPALHTLVETLYERYDLPECYITENGACYNMGVENGQVNDQPRLDYYAEHLGIVADLIRDGYPMRGYFAWSLMDNFEWAEGYRMRFGLVHVDYQTQVRTVKNSGKWYSALASGFPKGNHGVAKG

SEQ ID NO: 9871 - protein, 463 aa, Borrelia burgdorferi B31
MKIFLNNKKESFMGKYVKGLFFQFKNSDINYKKEILAGITTFLSMSYIIAVNPAILSNTGMPIGALVTATCLTAAFSTILMGLYTNTPLALASGMSLNAFFAFSVVIGMNIPWQVALAAVFIEGLIFILLSFLRVREQIINSIPINLKYSISVGIGLFIAFIGFVSGGIIIKNDATLVGIGSFVDLKVLFTFLGLFFIVIFEQLNVRGSILWAICSVTAIAWIYAIFNLEGAQAIGIQLPSRILKFESIGPIFNQLDFSYVLNEHFWTFISIVFILLFNDLFDTVGILISVTTKGGMLDKNGKIPNAKKILLVDGIATTFGAIMGVSTVTTYIESFTGIAEGGKTGLTSIVTGTLFLFAVFFAPLFIAVPASATAAALIYVGFSMCREIIKIDFFNIRENISSFLIFFLIPLAYSISSGFFVGAAFYILVNVSFNFFSKEKIKISPVLLILCLIFIIKFIYGY

SEQ ID NO: 9872 - protein, 451 aa, Borrelia burgdorferi B31
MNQSKETLLFQFKNKTIDYKKEIIGGITTFLSMAYIIAVNPAILSSTGMPIGALVTATCLTSAFSSILMGLYTNTPISLAPGMGLNAFFAFSVVIGMNIPWQVALAAVFIEGLIFIVLSLSRARESIANSIPVNLKYSITVGIGLFIAFIGFVNGGIIVKNDATLVGIGSFIDLKVLFTFLGLFFIVIFEQLNIRGSILWAICSVTAIAWIYAIFSPESAVAAGIRFPDGILRFESIGPIFNQLDFSYILSKHFWSFITIVLVLLFNDLFDTLGTLIAVAAKGNMLDKNGKIPNVGKIFLIDAISTTVGAIMGVSTVTAYIESCTGIEEGGKTGLTTIVTGIMFFIAIFLSPLFIAVPASATAAALIYVGFSMCREILKINFSNIRENIPSFLILFLIPLTYNISSGISIGIIFYVLINIILNLLENKKNKISPVMIILCLVFIIKFIYIY

SEQ ID NO: 9873 - protein, 375 aa, Archaeoglobus fulgidus DSM 4304
MDWIEREKKHILQTYTRQKVVIERGEGCYVYDVNGKRYLDLVAGIATVSIGHCNSHLVERLKEQLEKLIHISNLYYTTPQVELAEKLSEIAGMDRFFFCNSGAEAVEAALKFARRATGRKKFVSFTGDFHGRTMGALSVTHKEKFRKPFEPLVSPVEFAEFNNPESLEKVVDEETAAVIVELVQGEAGVYPADREFVKAIEELREKYGFLLIVDEVQTGFGRTGRWFAKDHYGIEPDMITMAKAMGSGVPIGCCALKEEVAEKIQVGDHGSTFGGNPLACTAALATIEVIEREGLVENSARMGEYFVKRLKESFENVIGVGLMIGFDVGDAAEFVRKCLENGLLVNNTSERRIRLVPPLVITEREVDKAVEIMLN

SEQ ID NO: 9874 - protein, 243 aa, Archaeoglobus fulgidus DSM 4304
MITVKGISKFFGELKALDGVSFEVEDGETCAIIGPSGCGKSTLLLIMAGLLKPSEGEVLVDDRAVNSPLKNAALILQDFGLFPWKTVYDNVALGLKIRGFSRRAERERVTALLEKFGLKGFEKSYPKQLSGGMKQRVAIARAIAIEPQILLMDEPLSSLDALSREEMQNFLLNLWKETKTTMVLVTHSIEEAVFLGRKIVVLTERPGRVKAVVDNREAGDESYRYEEVFFERCKLLRQTIRAT

SEQ ID NO: 9875 - protein, 359 aa, Archaeoglobus fulgidus DSM 4304
MVTGIVFHEEYLKHEQSPTHPERRERLAYTMDQLREEGIFESERIVLLEPFKASLEDVLEVHTEEYVRFLEMESKKGGIIDFDTNIPVGVFDRALLAAGGAIRAAQAVLNKECENAFAMIRPPGHHAKPYIGAGFCYLNNMAIMVKWLLKQGFERIAILDWDAHHGDGTQEIFYNDDRVLFISTHQMPLYPGTGYPEECGTGKGEGYTVNIPLPPGTGDEGYMMVIDEIIEPVVNEFKPQFIAISAGQDNHFTDPITSLALTARGYAEMMRRAVAMAEKHCDGRLVAVLEGGYSVEGALPYTNLGIIAAMAGFDLSAIREPENYLPELLWRKRDSALVKLKHNIEDVKRVHSKYWKCFK

SEQ ID NO: 9876 - protein, 436 aa, Archaeoglobus fulgidus DSM 4304
MAIEVELHKLREWMWKYSLGRDGGNNSDHFLRIKIPGGIISPDRLRGVAELSDKYGRGYAEITTRQDIQLHWIEAEDALEIFAEMEKLGFTTDLCSQAFAETCHGDVRNAVCCPLSGKKGYDAYWLVREITDFFSGNPDYVSLPHKFKIGISTCESNCIREEAQDLAMQWNGEGFVPLVGGGLGASKPGVRKAKSLRIVVYEEDAFDFIRTVIDIYKDFRAERKAEARFKNFFETAGCEWLRREIELRMGVKFDLADDFNCNPPSEHTEGLQDDGSNYYTLPVFAGILDSERLSFIAEVAEEFDGGIRLTPWQNVVFTDIDDLKALKERLSEQFDLSAPRMHIACASNFCGKTLVHAKDVLRHIPASDRFVGVSGCSNACACHPLAEIGLCGKVKAGKQLYDVFIHGWKEAENLSVEEAVELIKKHLGDGYGAKAD

SEQ ID NO: 9877 - protein, 378 aa, Archaeoglobus fulgidus DSM 4304
MPIFISYRSLNQNFFQYSINKSYMLFTPIETEHLRMKNRLVRSATAESMATKEGFVTEEMIELYTKLAEGGAGTIVTGYMFVSEDGRASFKMTGISDDSHIEGLSKLVEAVKAAAKDAVFVAQLAHAGRQTFLGNAIAPSAVKDPFTGVEPREMTREDIERVIEAFVKAALRAEKAGFDAVQLHAAHGYLLSEFISPHVNRRKDEYGQERAKILLDIFDGIRQRSRIPVMIKMNACDFVPGGLEIDEAVRIAKLLDDAGFEAIEVSGGMYESIYHNRYNVVSQKVAKSGEAYFREYAFRIKEAVSIPVMAVGGIKSRQTAEELLKKVDFVSMSRPLIRDPYLPKKMMNGEVDASDCKSCNLCLTAIFEGKPLACYAKN

SEQ ID NO: 9878 - protein, 439 aa, Archaeoglobus fulgidus DSM 4304
MKVAIIGGGAAGMSAASRVKALRPNWDVKVFEKSRWVSHAPCGIPFFVGGAVEKFDELCAYDIDYFKRERGIDVHTNARVVEIEEGRLTVDEGGKEASYEWDKLLFATGSKAVRLNVEGENLEGVIYVDDIENAERVKIEAMKVDNVVVVGSGYIGVEMADAITRLGKNVTVIEVMERPLPEYDAEIAAIIKSEMEKYVNLRLSEKVTAFEGKDRVEKVVTNKGEYPCELAIIAVGVAPNTDLAKGFVELGVKGAIRTNSRMETSRENVYAAGDCAESINIVTGREDWIPLAAPANKMGYVAGVNMAGLEMHYPGSLKSQLTGFKDIEIGKAGLSENEAIRFGYEVVSAFITSRTSARYLPGGLIHLKVVADRNGKLLGLQAVGKDVAMRVYAASALLHKNGDVKDLFFCDFPYYPPVSRVWDPLVVAARNIFRKLGLP

SEQ ID NO: 9879 - protein, 284 aa, Archaeoglobus fulgidus DSM 4304
MFSAHAPALVDYIYLIDRYPQRGGHSIILSTRKSPGGAGANVAHNLASLGVESTLFTTLGRDEDGIYFVENTLAKVKAEITDEKTGKVHVFVDGEGERTFFVEPNAAGKPFVEVDGGDYLYLDPFPSEHSFEVQRKEAERFDGFVILNPGFPYSSLGFERLKQILQHVDMLIMSADEFSLLGVETADVLRFVDYLIVTQGKLGSACYTKKGSFQSPAFPAKVADTTGAGDAFAAGFIYGFIKNYPLEVCLTLGNFCGAYNVERVGARNFPSKSTIDEFLARVLR

SEQ ID NO: 9880 - protein, 386 aa, Archaeoglobus fulgidus DSM 4304
MFKLADRLEKIPPYLFAEIDAMKRKKLQEGVKVIDFGVGDPDLPTPEHIVEALKNAAEKVERQKYPSYEGMLSFRESVARFYRRRKGVNLDPESEVISLIGSKEGIAHLPLAFVNDGDYVLVPEPGYPVYYSSTLLADGVPYEMPLKEENKFLPDFQLIPDEIARKAKIMFLNYPNNPTAAVAPKEFIKEAIDFCIDNKIILAHDAAYSEITFDGYKAPSFLEFEDAFEVCVEFNSLSKTYNMTGWRIGFACGNRDILAGLLKVKTNVDSGVFEAIQEAAIAAMDGPDRVIEENCKVYQRRRDLLVEGLRDVGIDAEKPKATFYVWAKVGGSSIEFVKQLIDKAGIVATPGIGFGKSGEGFVRFALTRGEGVIEEAIDRLKTILHK

SEQ ID NO: 9881 - protein, 275 aa, Archaeoglobus fulgidus DSM 4304
MHIDSYFSLSNCDAEEAEYLIYGIPYDATQSFKPGSRFAPNAIREASWNLESYSNLFDVELSLVKVGDAGNINCDGGFEQIVERTKEFLGEVEGFPVAIGGEHSISFAATSKFRKACFVVFDAHFDLRDEFDGDRFNHACTTRRIFESGMRVAIFGVRSGIKEEKRFAEENGIKYLHAWDFEVEKAVKMVEDFDKIYVSLDVDAFDPAFAPGVSTPEPFGLKPIDFIRFFAGIADRVVGFDVVEVVPDSNKVTQTLAAKIILEAIAAKVRCDIPK

SEQ ID NO: 9882 - protein, 217 aa, Archaeoglobus fulgidus DSM 4304
MNLIFLGPPGAGKGTQAKRVSEKYGIPQISTGDMLREAVAKGTELGKKAKEYMDKGELVPDEVVIGIVKERLQQPDCEKGFILDGFPRTLAQAEALDEMLKELNKKIDAVINVVVPEEEVVKRITYRRTCRNCGAVYHLIYAPPKEDNKCDKCGGELYQRDDDKEETVRERYRVYKQNTEPLIDYYRKKGILYDVDGTKDIEGVWKEIEAILEKIKS

SEQ ID NO: 9883 - protein, 242 aa, Archaeoglobus fulgidus DSM 4304
MAQLEIIDLHKRFGELEVLKGVTMKVEKGEVVVIIGPSGSGKSTLLRCINRLEEPTSGKILLDGVDITNSKIDINKVRQRIGIVFQQFNLFPHLTALQNVTLAPIKIKKMSKREAEELGMRLLEKVGLEDKADYYPAQLSGGQQQRVAIARALAMNPEVMLFDEVTSALDPELVKEVLDVMKQLARDGMTMVVVTHEMGFAREVGDRVIFMDGGVIVEEGKPEQIFSNPKHERTRKFLSMIL

SEQ ID NO: 9884 - protein, 381 aa, Archaeoglobus fulgidus DSM 4304
MRFKMVSEDDIKNGIVTDKYFIWTEKVLKAKNVNPTVVAEVTTSGWGVFAGLEDALNLLEGLPIDVYAMPEGSLFFPHEPVMTIVGKYQDFARYETSLLGFLCHASAVATQAFRFKLAAGDKRVYSFGTRRMHPAIAPAIERAAYIGGVDGVSNYSAEKYLGLKSMGTMPHAMIICFGNQVEAWRSFDEVVDKEVPRTMLVDTYFDEKTEAVMAVENVENVSGVRLDTPSSRRGKFRKIVEEVRWELDIRGKQHVRIFVSGGLSLKDVLELRDIVDAFGVGTAISGANPVDFALDIVEREGRFAAKRGKRGGMKQVYRHWDELRDEVKLFREEYSGKGEPLLRKVIEGGKIIENTDMEKARELVLRQMEIIRKLGREEEFL

SEQ ID NO: 9885 - protein, 464 aa, Archaeoglobus fulgidus DSM 4304
MEFISSRDMQILDTNCEYFGLSRMLLMENAGKGVAEEVMKRFYEGKVQIFAGSGNNGGDGFVAARHLKGFDVEIFLLSKPKTELAIKNLEICRKAGFPVKEGLPEEIDADIVIDAMLGTGVRGRLREPYSTAVKMINESDAFKVAVDVPTGLDPDSGSYEEAVKADLTVTFHKAKPGLAKAREVCGEVAVKDIGIPESFENLCGPGDVAFSYKRYEDAHKGVHGKVLVVGGGDYTGAPALASLAALYAGADIVTTAVPMAIRKVVASFSPNLIVRGVGEERIEMKNLEELEELVKRHDVVVAGMGVGENPEFKEVVEELLKSCKKAVLDAQGIVDSVPENCECILTPHRGEFGRVFGDTEVQKAALKAKAVILLKGREDVITDGSRVKVNRSGNAGMTVGGTGDVLAGIAAAFLCNDDAFHSACAAAFLNGLAGDVCFEKFGYNYTATDLVKAIPEAILRCKSF

SEQ ID NO: 9886 - protein, 257 aa, Archaeoglobus fulgidus DSM 4304
MRVAVSGAAGRMGRLVVKNAVAEGLKVVQAFDINEVGKDAGELAGVGKIGVPIEDDISKLDADVLIDFTTAEAAMKNAEVAAEKGVRVVMGTTGFTDEDRKRLAELAEKVPMIVSPNFSLGVNIFWKIVEYAAKMLYEWDAEIVELHHRHKRDSPSGTALKLAEIIRKVKEEKGIEADLKTCREGISPRESEIGVFGIRGGDVVGEHTVFFFGSGERIELTHRAMSRECFAIGAVRAAKWIAKVDKPGFYTMDDFLE

SEQ ID NO: 9887 - protein, 491 aa, Archaeoglobus fulgidus DSM 4304
MVRRLRGDCMEEVERAKAVLKENNVRQVLCAFADVRGYLQMFSIPAREFVDGSAFENGIGFDGSSVRGFRTIEKSDMVWMPDASSLKIIPWIDDPIQKSAIMFGNVYEAWGTEIADCDPRGYVAKRYEDMLKSEGMSAIFGPEIEFFLFEGVDFTRLSWDMWVSPNGGAGDSWGPPRIMPISSELESGYMIRPKEGYFRPPPEDTTVEYRNELVYYLEQLGIDIEYHHHEVATAGQVELDFKPKQLVDVGDAFYLYKFAAKNIAAMHGLYATFMPKPLYLDNASGMHTHQSLWKGEPFSGEAVFADPDDEYMLSQKARYYIGGLLEHAKALTALCAPTVNSYKRLVPGFEAPIYICWSPRNRSALVRVPMYVKKPSAIRVEYRGVDPSCNPYLAITAQLAAGLDGIKKKIDPGDPLLEDVYELTPAQKRELGVGELPTTLRDAIDHLASDELMQEVLGSHIFDAFMELKIDEWNQYCLYITPWEFMKYFDI

SEQ ID NO: 9888 - protein, 429 aa, Archaeoglobus fulgidus DSM 4304
MKYDYVIIGNSAGGIGCVEAIRELDVDSSILVISAEKYHAYSRALIPYYLDGKIEFEKMYYRPPDFYEKMDVETKLGVRAVGVDVEAKKVLLESGEEVEYGKLLIATGGKPFIPPMEGLGGQSNVFTFLKMDDVLAVEKAIKEAKKAVVLGGGIIGLMASEVLAKKGLDVKVVELADRVLAPVVDETTSRIVERKFEENGVEIILNNTISKVVGEERVEKVILRDGRELEADMLLVAVGVVPNVDIVKNTPIKVNRGIVVNRKMETSVKDVYACGDCAEIYDFVFGANRVLPLWPTAYTGGRIAGFNMVGIEREYNLATSMNAMHFFDYYIINAGLNVPNDSEEFEVIYRLEGDSYRKFALKDGRIAGFIIAGKMERAGIFLKLMEEGIDVSSFKEKLLKDNFGFLDIPEPTRWKLIEDKIKLGVVREI

SEQ ID NO: 9889 - protein, 395 aa, Archaeoglobus fulgidus DSM 4304
MFRGVDFYNVDELLSDEDRLVRQSVREFLEKEVVPLVADAWHEEKPLNFHELGKKFGELGMLGTFLPEEYGCPGMTYTTFGVVCQEVERVDSALRSFVAVTSGLVMYPIWRYGSEEQKGEYLPKLARGEIIGAFGLTEPNHGSDPGSMEATARRDGDEWVLNGTKTWISEADVADIAVVWARDVEDGKIKGFIVERGTKGFQQTAITKKASMRAGSVGELGLVNCRVPEENRLPEARGLGAPLSCLNQARFGISWGAIGAAMDCYETALNYTKERKQFGAPLASYQLVQEKLVNMLIEITKGQLLAWRLAKLMDEGKATTEQISMAKKNNVRVARYCARTARELLGANGISLDYSPIRHMANIESVYTYEGTDDIHTLILGRAITGYQAFRRELR

SEQ ID NO: 9890 - protein, 228 aa, Archaeoglobus fulgidus DSM 4304
MKVVELRNVYKIYRTEYYEVRALDGVSMDVEEGEFVVIMGPSGSGKSTLLNLIGCLDKPTEGEVLINGVETSSLNDNRLTELRRDTIGFIFQTYNLIPTLTALENVELPMIFKGVGRREREERAKELLKNVGLEKEMNRKPNEMSGGQQQRVAIARALANNPKILLCDEPTGNLDTKSGEQVMEIIRHQNEVLGVTVILVTHDPSLAKYGDRVIRLRDGKIESVENVS

SEQ ID NO: 9891 - protein, 275 aa, Archaeoglobus fulgidus DSM 4304
MLEVRNLFKRYGSFEAVKGISFSVRRGEVLGLIGENGAGKSTTLKILAGLIRPDGGEVRYFGKDFDEEMKRIIGYLPEIDALYDNMTVSEYLNLFADIYDVRADIDGLLERLNLPDKYISDLSKGMRRKVSIARTLLHDPEVLVYDEPTGGLDPTTSLSIAELLRELAERGKIIVFSAHNMYYVERIADKVVVMKGGKALYFGSLEELIGQNTIYKVEYTIDGRKESVKLFEVEELLDFAEKVRKQGGKIIEIEREVPRLENVYFSLIGRKEIKA

SEQ ID NO: 9892 - protein, 448 aa, Archaeoglobus fulgidus DSM 4304
MKTLILAGGKGTRLWPLSRELMPKQFIKLFSESLFQKTVKRALYLSSPDEIYVITNKEYRFRVLDDLEEIGISIPEENIILEPEAKNTLPAICLGVKAAGEGKFAVLPSDHLIKADEEYLNAFRSAEKLSENYIVTFGITPTRPHTGYGYIKPGKELEGGFEVEQFKEKPSRELAEEYVSKGYLWNSGMFVFDSKVFVEELKELAPEFAKVLEEGEEAYKQIPEASFDYAILEKSGRVAVVPIKTFWSDLGNFDSIYEVMEKDERGNAIKSESCIPVDSENNLVITQRLTALIGLRDLIVIDTDDALLVARRGEAEKVREVYRLLAEKGDKAVEVHRTAHRPWGSYTVLEENKSYKIKRITVKPKKRLSLQRHYHRSEHWVVVKGTARIVVDGNEILLRSGESTFVPAGAIHRIENPGKIPLEIIEIQIGEYLEEDDIERFEDDFGRR

SEQ ID NO: 9893 - protein, 366 aa, Archaeoglobus fulgidus DSM 4304
MAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 9894 - protein, 407 aa, Archaeoglobus fulgidus DSM 4304
MMIDGLPTLDDIPYRGKHVLLRVDINAPIVNSTILDTSRFESHIPTIEALEDSKLVLLAHQSRPGKKDFTSLESHASTLSKLLGKRVEYIDEIFSKGVLRRIKEMENGEVILLENVRFYSEEQLNRSAEEHAECHMVRKLSTAFDLFVNDAFSASHRSHASLVGFVPVLPSVVGRLVENEVTALSKPLKGEGRKIFVLGGAKIKDSVKVLKNVLENNIAEKVVLTGVVANYFLMLKGYDIGEVNRKVVEDNKEDVSDEEMINILKKYSDKIILPIDLGIEKDGVRVDIPLEKFDGKYRIMDIGLETVNQLSEIIPKYDYVVLNGPAGVFEDERFSLGTYEILRAATRAGYSVVGGGHIASAARLFGLSDKFSHISTAGGACIRFLSGEKLVALEVIKEYWAKKWGKS

SEQ ID NO: 9895 - protein, 418 aa, Archaeoglobus fulgidus DSM 4304
MKLDKSRKLYAEALNLMPGGVSSPVRAFKPHPFYTARGKGSKIYDVDGNAYIDYCMAYGPLVLGHANEVVKNALAEQLERGWLYGTPIELEIEYAKLIQKYFPSMEMLRFVNTGSEATMAALRVARGFTGRDKIVKVEGSFHGAHDAVLVKAGSGATTHGIPNSAGVPADFVKNTLQVPFNDIEALSEILEKNEVAALILEPVMGNSSLILPEKDYLKEVRKVTAENDVLLIFDEVITGFRVSMGGAQEYYGVKPDLTTLGKIAGGGLPIGIFGGRKEIMERVAPSGDVYQAGTFSGNPLSLTAGYATVKFMEENGVIEKVNSLTEKLVSGIADVLEDKKAECEVGSLASMFCIYFGPTPRNYAEALQLNKERFMEFFWRMLENGVFLPPSQYETCFVSFAHTEEDVEKTVEAVSESL

SEQ ID NO: 9896 - protein, 246 aa, Archaeoglobus fulgidus DSM 4304
MTMTLAKRFTAEVVGTFILVFFGPGAAVITLMIANGADKPNEFNIGIGALGGLGDWFAIGMAFALAIAAVIYSLGRISGAHINPAVTIALWSIGRFPGREVVPYIVAQFIGAALGSLLFLACVGPAAATVGGLGATAPFPGIGYGQAILTEAIGTFLLMLVIMGVAVDERAPPGFAGLVIGLTVGGIITTIGNITGSSLNPARTFGPYLGDSLMGINLWQYFPIYVIGPIVGAVAAAWLYNYLAKE

SEQ ID NO: 9897 - protein, 226 aa, Archaeoglobus fulgidus DSM 4304
MKVIELVDVYKIYRTAYYEVHALDGVSMEVEAGEFVAIMGPSGSGKSTLLNMIGCLDKPTKGEVIINGVKTSGLSDRELTKLRRDSIGFIFQQYNLIPTLTALENVELPMIFRGVARAERERRAKELLKVVGIEELADRRPREMSGGQQQRVAIARALANNPKILLCDEPTGNLDTKSGRQVMGILKNLNEENGVTVVLVTHDPSLSEYADRVIRIRDGKVVEDVY

SEQ ID NO: 9898 - protein, 248 aa, Archaeoglobus fulgidus DSM 4304
MIDRSLIVFFTACYPTAEKTVEFMLTAAESGADVIELGVPFSDPVADGKTIQESYVRALRNFRVERVFEIAKAFRAESDKPLVLMSYYNPIYRRGVESFVEKAYSSGIDAMLVVDLPYDEAGDFVEVCSRTGMKNVFLAAPNTPEDRLRAMDELSAFVYLVSTYGVTGERDRISPLAFEALKRAKGICRKPVAVGFGVSKADHVRQLISAGADGVVVGSAFVRLINEKGERATEDIRALTENLRSGLV

SEQ ID NO: 9899 - protein, 345 aa, Archaeoglobus fulgidus DSM 4304
MVGYAVELEGISKSYDSTTVLEDINLRIQQGEFFSLLGPSGSGKTTIIRIIAGLTFPDQGFVRINGEDCTSLPPYRRNVGMVFQNLALFPHLNVFENVAYGLRLRKIPEGEIKDRVYRYLELVNLDPEIYAKRKVEQLSGGQQQRVAIARALVTEPSILLLDEPLGALDLKIRQHMISELKRIQKTLGTTFIYVTHDQSEALLLSDRLAVLNEGRIHQIGTPREIYERPKTRFVASFIGETNFLEARVVNGEVITEIGKVRVFGLDGAREFCISIRPEKLKINQQAENTFEAVVEEIGYLGSFLMLKLRAGDVVVKAFAPPQENVREGERVIVGWDSRDAVILEA

SEQ ID NO: 9900 - protein, 311 aa, Archaeoglobus fulgidus DSM 4304
MLDMPIDPVYYQLAEYFDSLPKFDQFSSAREYREAINRIYEERNRQLSQHERVERVEDRTIKGRNGDIRVRVYQQKPDSPVLVYYHGGGFVICSIESHDALCRRIARLSNSTVVSVDYRLAPEHKFPAAVYDCYDATKWVAENAEELRIDPSKIFVGGDSAGGNLAAAVSIMARDSGEDFIKHQILIYPVVNFVAPTPSLLEFGEGLWILDQKIMSWFSEQYFSREEDKFNPLASVIFADLENLPPALIITAEYDPLRDEGEVFGQMLRRAGVEASIVRYRGVLHGFINYYPVLKAARDAINQIAALLVFD

SEQ ID NO: 9901 - protein, 468 aa, Archaeoglobus fulgidus DSM 4304
MVGRMCVAVLIVLLLVATAGADPNGAETLKENPELPVDFVWALICGFLVMFMQAGFAMLEAGFSRAKNVANVMMKNLMDFAVGSLAFFAVGFALMMGADWQGIAGTTGWFLAGESYDVSTIELWFFMLVFAATAATIVSGSIAERPKFSVYLVYSAVVSAVIYPIYGHWLWGGGWLSSSEFMVKLGGGYGALDFAGSGVVHALGGYIALAAVMLLGPRLGKYDSDGNPRAIPGHNLAFAVIGTFILWFGWFGFNAGSTLSAHELRVSIIASNTNLAAAAGAVTAMAITWLRNGKPDVGMTCNGAVAGLVAITAPCAWVQPWSSVVIGTIAGFIATYGYWWLEKRGLDDVVGAIPVHGFSGTWGLIALGIFADGSYGLYATESPLVTGLLYGNWGFFIVQLISAIVNFAWAFGTGFALFWILKKVIGIRVSPEEEMLGLDIAEHAAVAYPNFVCTETELPLAMKQGGGR

SEQ ID NO: 9902 - protein, 157 aa, Archaeoglobus fulgidus DSM 4304
MKVLISSSVKEGIECLAKRLAEMGYEILATEGTADYLQEKGVNALKLSEITGIAESKSIKTLHPKIYEMIFSGEIKAVVVIPYNLRENPCRENIDIGGISLLRAAAKAGVPAAYDLKSFQKLVEVLEGKKRYNAAEVFRFTSEYDRTIAEWLENEAP

SEQ ID NO: 9903 - protein, 424 aa, Archaeoglobus fulgidus DSM 4304
MGFTGRRGKAEIIEAFSKHVSPYKAKFFSMVGIDFVPARREGVWYWDLDGRKLMDCHCNGGVFNLGHRHPEIVKTLVEALDELDIGNHHLISEQRARLAEKLAELMPGDISRTVFGVGGGEAIDFAIKLARGHTGRKKIIYAKGGYHGHTGFALAAGDEKYRKPFEPLAPGFVEVPFGDAEAVEKAVDDDTAAVLFETIPATLGMPLPPEDFYRRVREICDEKGCLMIMDEVQTGLGRTGKMWGIEHYKVVPDVIVTAKGLSGGVYPISATCFKEGLDDFMAENPFIHVSTFGGAELGCVVAEKVLEITSRESFLENVRKTGEALSEILGKLKDEYDFVDEIRQKGLFIGIKMVEEGWGPLLSISCYHSGILAVYANNDTSVMQFLPPLIVGEKEVDYIREKLAGAMEIASQRREMVEFIRKML

SEQ ID NO: 9904 - protein, 448 aa, Archaeoglobus fulgidus DSM 4304
MCIMKYDVLIIGGGPAGIVTATTAKKFYPAKSVAIIKKEETSLVPCGIPYIFKTLGSVEADVMPTKPAENLGIEFIIDEVEDVDVKAKVVRTKGGKSISYEKLVFATGSTPVMPRIEGVEKKGVFTVSKNIEELRKLHEAVKKAEKVVIVGGGFIGVEVGEQIAKAGKKFTMVEMMDQLLPAAFDKEFARIAEEELKKLGVEVYLNSTVKRITGNSSVEAVELADGRKIEADVVIMSVGYRPNIELAKKAGLRISIGNRIWTDEYGRTSEKDVFAVGDCSEEKDFFTRETSRVMLASTATFEARIVGANLYSLKVVRVNKGTVGVFSTFVGDVALGAAGLTEEMAKKEGFEVVAGYGESLNRHLASIPGAAKTKVKLIFAKESGVILGGQVTGRYEVGEMVNQIAMAIQNNLTASEIDTLQIGTHPLLTSAPTTPPVILAAEDALRKM

SEQ ID NO: 9905 - protein, 509 aa, Archaeoglobus fulgidus DSM 4304
MVREFDYIWQYLDHWADVDEKYPAIKFKDKEISYGELKENANRLAASLLKLGVGKGDRVATVLPMTPEYVCTFLACSKIGAICVPMDVRYRTAELRRFLSHAEPKVIISVESFQENNQRKILDEIKEEIGNPEIFFVGEFDELLKSEPLGKAVEQEPNDDILIIFTGGTTGVPKATLLSHINIVSMALGELKSIIRYIGREERMNMLVHLPPSHVGGTTELLATGLVNGSKMVLIDHWRPDTVLKELKEEKIAFFGAVPTMFALIFSLNVPLPPVELLVTAGEKLNPELLKRMMQWCEKIGVGYGSTETAGFATFSLPEDDPLKFTEGYVGVPFEGVDVRIVDDEGNELPDGEIGEVLVKGPMVSKGYFRQPEETEKGFRDGYWVSGDLGFKKGKELYIVGRKKEVIRVGSYTVLPSEVEEVVMKNPKVGIAAAFGYPHEIYGEVVWVAVVPRAGEVVSEEEIIEACKKELADFKVPRKVLIMDSIPLTRLGKADRIKLKEIILKEFFE

SEQ ID NO: 9906 - protein, 108 aa, Archaeoglobus fulgidus DSM 4304
MELQFDEKGLIPVITQDVKTKEVLMLAYANEEAIKLTLKTGFAHYWSRSRKKLWKKGETSGNVQRVVEIRYDCDCDALLYLVEQKGNACHTGNYSCFYRRLEGDEVRC

SEQ ID NO: 9907 - protein, 401 aa, Archaeoglobus fulgidus DSM 4304
MGEFSKFEKLIVLLAAAIGWSHDAVGLTLLNFLAEPIMREFNVGTLEIGFIFSAQYIFCIFGAMLFGEMGDRFGRKNALILSILWVAVFSVLSAFAPNFWTLAILRLISGMGVTWGLAFTYMSEFYSPKRRGLFGGLIHATFVFGFILSALSVSLIYPIYGWRACFFVTLYPIPFLILFAKYLPESRIWEKHSAEMDKSLRLAEIVRESRYLRLLVLATFLFWLAEFAYHAIVDWSPTFIIRQFNYRPEEASMIVLRISLVALIVLPFFGLISDYIGRRSSFAISASIGLLGCLMLAYFTLVNYNPGLALLSLFVIPIGFGSHALFGVWSSEMFPTKVRATATSVIFSIARGLSVGGLIVGYVATFSSLLYGMLLGGIAFLLMCIFPWLLPETKGRELEEF

SEQ ID NO: 9908 - protein, 210 aa, Archaeoglobus fulgidus DSM 4304
MKELMRNVYLLDDTLVTKSKYGSHYGEKVFDGYREWVPWRSKLAAMILKGHRLKLRGDERVLYLGAASGTTVSHLADIVDEGIIYAVEYSAKPFEKLLELVRERNNIIPLLFDASKPWKYSGIVEKVDLIYQDIAQKNQIEILKANAEFFLKEKGEVVIMVKARSIDSTAEPEEVFKSVLKEMEGDFKIVKHGSLMPYHRDHIFIHAYRF

SEQ ID NO: 9909 - protein, 261 aa, Archaeoglobus fulgidus DSM 4304
MSKLRYNLWFGVYDGKEIKLSENFEESFLKAENPSPLPFNVSEVGAKALGKDYYRILRKTALAVSEKMVEKELRREDRYVVALVKALEEIDESINMLNEKLEDIRAVKESEITEKFEKKIRELRELRRDVEREIEEVMEKIAPNMTELVGAKVAAKLLERAGSMERLVRLPASKIQVIGAEKSLYKAFARMKKGKKAKIPKHGIIFLHPFIRTLPKAKRGKMARFLAAKLAIAAKIDYFRGEIDESLYESIRRRYEELRRK

SEQ ID NO: 9910 - protein, 269 aa, Archaeoglobus fulgidus DSM 4304
MVWFFEYYDGCGLAIKVKKKLYEAEGVQKVEIYETESMGKMLVIDGKIQLTELDEPFYHEMLVHVPMLSHENPRKVAVIGGGDGGALREVLKHNVERAVLVDIDRNVIDLSRKFLKIDHGAFEDERVEIAIMDGKEFLRDCEIFDVIIVDSTDPVGVSDTLFDREFFELARQKCDVISLQSQSPLIQKEYFRTLLVNSAPFERRDVYLSCVPTYPLALWSFIIGGEYDFSNLEERFERIKGKTVHYNPDVHRAAFALPEWLKKEVEACI

SEQ ID NO: 9911 - protein, 494 aa, Euglena gracilis
MSATQLLGGYQTISERTAPQNKLAVVGAVAVIAVASGVAAGYALNLSMPPLLPPCAPLAHGHLSRTTWHRPTPAAVAFASASEGAQTFVAPAAQSSNTFATSSVAASIGMVMGAGAVLLARMNQKPVAMNAWTGSVYGVLSQLWRSHGPSMLMSVRQDHLHPWQGILAADESRPNKTCGARLKSIGVENTEENVHSSRSCVHRTWLQRGNILGVIMYEETLYQKDKNGKPFVQIINEAGAVAGVKVDTGIAPLPGADDEGYTMGLDGLRERCQEYYRQGARFAKWRAVLRIDSKGLPSDRSILANATGLAQYAAICQECGLVPIVEPEILMDGDHDIETAAAAAERVLVAVYDALATQGVLLEGTLLKPNMVTPGVDSGIKATPETLPIFTCALLATVPAAVAGISFLSGGSSEEDASLNLNAINAIPYERKPWALTFSFGRALQASTLKTWGGKDENIARLRRCSLSVPSQWPGKYQGSGQAGESLFVKGYKY

SEQ ID NO: 9912 - protein, 475 aa, Vigna radiata var. radiata
MSPQTETKASVGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIIMHDYLTGGFTANTSLAHYCRDNGLLLHIHRAMHAVIDRQKNHGMHFRVLAKALRLSGGDHVHSGTVVGKLEGEREITLGLVDLLRDDFVEKDRSRGIYFTQDWVSLPGVIPVASGGIHVWHMPALTEIFGDDSVLQFGGGTLGHPWGNAPGAVANRVALEACVKARNEGRDLAREGNEIIREASKWSPELAAACEVWKEIKFEFEAVDTI

SEQ ID NO: 9913 - protein, 386 aa, Medicago sativa
MAIHHHHHNHQQLQQHTSSLFDALYCDEEEKWEDDDEGEVVDEGAQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDNGVDYKNQLLNVLKISKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 9914 - protein, 310 aa, Alicyclobacillus acidocaldarius
  misc_feature (53)..(53): Xaa can be any naturally occurring amino acid
  misc_feature (64)..(64): Xaa can be any naturally occurring amino acid
  misc_feature (210)..(211): Xaa can be any naturally occurring amino acid
MPLDPVIQQVLDQLNRMPAPDYKHLSAQQFRSQQSLFPPVKKEPVAEVREFDXDLPGRTLKVRXYRPEGVEPPYPALVYYHGGGWVVGDLETHDPVCRVLAKDGRAVVFSVDYRLAPEHKFPAAVEDAYDALQWIAERAADFHLDPARIAVGGDSAGGNLAAVTSILAKERGGPALAFQLLIYPSTGYDPAHPPASIEENAEGYLLTGGXXLWFRDQYLNSLEELTHPWFSPVLYPDLSGLPPAYIATAQYDPLRDVGKLYAEALNKAGVKVEIENFEDLIHGFAQFYSLSPGATKALVRIAEKLRDALA

SEQ ID NO: 9915 - protein, 374 aa, Escherichia coli
IHTSPYSKDAPLVASLSVNQKITGRNSEKDVRHIEIDLGDSGLRYQPGDALGVWYQNDPALVKELVELLWLKGDEPVTVEGKTLPLNEALQWHFELTVNTANIVENYATLTRSETLLPLVGDKAKLQHYAATTPIVDMVRFSPAQLDAEALINLLRPLTPRLYSIASSQAEVENEVHVTVGVVRYDVEGRARAGGASSFLADRVEEEGEVRVFIEHNDNFRLPANPETPVIMIGPGTGIAPFRAFMQQRAADEAPGKNWLFFGNPHFTEDFLYQVEWQRYVKEGVLTRIDLAWSRDQKEKVYVQDKLREQGAELWRWINDGAHIYVCGDANRMAKDVEQALLEVIAEFGGMDTEAADEFLSELRVERRYQRDVY

SEQ ID NO: 9916 - protein, 322 aa, Salmonella typhimurium
SKIYEDNSLTIGHTPLVRLNRIGNGRILAKVESRNPSFSVKCRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 9917 - protein, 276 aa, Zea mays
MHRDRGVSAAAIPGDRKRIGEPMDRSSPSTSWGFSGGREKERIGVGKQPEMPRSGGGSTAMSKSKLSDAESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKP

SEQ ID NO: 9918 - protein, 273 aa, Zea mays
  misc_feature (202)..(202): Xaa can be any naturally occurring amino acid
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYRNYDFGRCPRVYCCGQPCLPVGXSDIHRSSTVKIYCPKCEDIYYPRSKYQGNIDGAYFGTTFPHLFLMTYEHLKPQKLSQRYVPRVFGFKLHKP

SEQ ID NO: 9919 - protein, 509 aa, Pichia angusta
MVKLQSYYPLFRPGKPTQHILTVTCMFAFILYGFEQGALANVQNEVVFQSQFGHPQGNYLGIIVAIYNLGSFFGSMANIWIGDKLGRKRAIWLGFTLVTIGVILQCSSYSVVQLFIGRFISGLGTGFETSTTPMYQSEVCHENHRGGLVAAEPQGVAFGITVSYWIGYGCSKRTDQVSWRLPVGIQMLFAVLGIVMLFFCPESPRWLMKVGRTQDARYSLATINGVPEDHPRISAIIDDILYLQKIEGSGDKITWGDILMGRDAMHGRFRIMLTVFGQFWNQFGGINLVVYYVPMVLENNVGLSSNLATILGGCIMLTFFATGFIPTLFLDKMGRRFAMASGSAGQCISMLLVTILLRVGTKESSVAATAFFFTFIGFFGYAMNCVPWVYAAEVLPLQLRAKGNAISVATNWICNFVIAMITPIMTQNLAWKTYIVFTLTNAVATIHFFVFYPETSKRTLEDIENIFLDSHTIFYGLQEIKRTPTERLTEKLIDIEHVESVEEGSPESD

SEQ ID NO: 9920 - protein, 483 aa, Escherichia coli
MSQCLYPVIIAGGTGSRLWPLSRVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 9921 - protein, 485 aa, Flaveria bidentis
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQYIAYVAYPLDLFEEGSVTNMFTSIVGNVFGFKALRALRLEDLRIPTAYVKTFAGPPHGIQVERDKLNKYGRPLLGCTIKPKLGLSAKNYGRACYECLRGGLDFTKDDENVNSQPFMRWRDRFLFCAEAIYKAQAETGEIKGHYLNATAGTCEEMLKRAVFARELGVPIIMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 9922 - protein, 485 aa, Flaveria pringlei
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQYIAYVAYPLDLFEEGSVTNMFTSIVGNVFGFKALRALRLEDLRIPTAYVKTFEGPPHGIQVERDKLNKYGRPLLGCTIKPKLGLSAKNYGRACYECLRGGLDFTKDDENVNSQPFMRWRDRFLFCAEAIYKAQAETGEIKGHYLNATAGTCEEMLKRAVFARELGVPIVMHDYLTGGFTANTSLSHYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 9923 - protein, 404 aa, Hypocrea lixii
MQTFGAFLVSFLAASGMAAALPTEGQKTASIEVAYNKNYVAHGPTALFKAKRKYGAPISDNLRAAVAAKHSLTKRQTGSANTNPSDSADDEYITSVSIGTPAQVLPLDFDTGSSDLWVFSSETPKSSASGHALYSPSKSSTAKKLSGSTWSIEYGDKSSSSGDVYTDIVTIGGFSVKTQAVESATKVSTQFVQDTVISGLVGLGFDIGNQVSPRPQKTWFSNAASSLAEPLFTADLRHQETGSYNFGFIDTSLAKGTIGYTPADGSEGYWGFTATGYSVGGAKLNRNSITGIADTGTTLLLLPDNIVDAYYNNVESAQYDDSQEGVVFDCSEDLPSFSFGVGGQTITISGDLLNLTPIEEGSSTCFGGLQSSADIGINIFGDVALKAALVVFDLGNERLGWAQK

SEQ ID NO: 9924 - protein, 202 aa, Hypocrea jecorina
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNTKPSVHVGQGQGVGNSSSSSCC

SEQ ID NO: 9925 - protein, 206 aa, Aspergillus niger
MAGTRNYDFLIKLLLIGDSGVGKSCCLLRFSEDSFTPSFITTIGIDFKIRTIELDGKRVKLQIWDTAGQERFRTITTAYYRGAMGILLVYDVTDERSFQNIRTWFSNVEQHASEGVHKILIGNKCDWEEKRAVSTEQGQQLANELGIPFLEVSAKNNINIEKAFYDLASDIKKGMDTSKSEQVGSQGVSIDQQGSGLNGSAGGKCC

SEQ ID NO: 9926 - protein, 201 aa, Aspergillus niger
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 9927 - protein, 474 aa, Corypha umbraculifera
PQTETKASAGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIIMHDYLTGGFTANTSLAHYCRDNGLLLHIHRAMHAVIDRQKNHGMHFRVLAKALRMSGGDHIHGGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9928 - protein, 473 aa, Corypha taliera
QTETKASAGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIIMHDYLTGGFTANTSLAHYCRDNGLLLHIHRAMHAVIDRQKNHGMHFRVLAKALRMSGGDHIHGGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9929 - protein, 472 aa, Eugeissona tristis
TETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIIMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9930 - protein, 469 aa, Hedyscepe canterburyana
KASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLIHIHRAMHAVIDRQKNHGMHFRVLAKALRMSGGDHIHAGTVVGKLEGERDITLGFVDLLRDDYIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEIWKAIKFEFEPVDKLD

SEQ ID NO: 9931 - protein, 473 aa, Gronophyllum chaunostachys
QTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDYIEKDRSRGIFFTQDWVSMPGVIPVASGGIHVWHMPALTEIFGDDSVLQFGGGTLGHPWGNAPGAVANRVALEACVQARNEGRDLAREGNEIIREACKWSPELAAACEVWKAIKFEFEPVDKLD

SEQ ID NO: 9932 - protein, 474 aa, Beccariophoenix madagascariensis
PQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9933 - protein, 469 aa, Rhapidophyllum hystrix
KASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAIFARELGVPIVMHDYLTGGFTANTSLARYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9934 - protein, 474 aa, Sclerosperma mannii
PQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIFKAQAETGEIKGHYLNATAGTCEEMMKRAVFARELGVPIIMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLD

SEQ ID NO: 9935 - protein, 473 aa, Phytelephas aequatorialis
QTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREACKWSPELAAACEIWKEIKFEFEPVDKLD

SEQ ID NO: 9936 - protein, 340 aa, Irpex lacteus
AAGSVPATNQLVDYVVNVGVGSPATTYSLLVDTGSSNTWLGADKSYVKTSTSSATSDKVSVTYGSGSFSGTEYTDTVTLGSLTIPKQSIGVASRDSGFDGVDGILGVGPVDLTVGTLSPHTSTSIPTVTDNLFSQGTIPTNLLAVSFEPTTSESSTNGELTFGATDSSKYTGSITYTPITSTSPASAYWGINQTIRYGSSTSILSSTAGIVDTGTTLTLIASDAFAKYKKATGAVADNNTGLLRLTTAQYANLQSLFFTIGGQTFELTANAQIWPRNLNTAIGGSASSVYLIVGDLGSDSGEGLDFINGLTFLERFYSVYDTTNKRLGLATTSFTTATSN

SEQ ID NO: 9937 - protein, 427 aa, Rhizomucor pusillus
MLFSKISSAILLTAASFALTSARPVSKQSDADDKLLALPLTSVNRKYSQTKHGQQAAEKLGGIKAFAEGDGSVDTPGLYDFDLEEYAIPVSIGTPGQDFYLLFDTGSSDTWVPHKGCDNSEGCVGKRFFDPSSSSTFKETDYNLNITYGTGGANGIYFRDSITVGGATVKQQTLAYVDNVSGPTAEQSPDSELFLDGMFGAAYPDNTAMEAEYGDTYNTVHVNLYKQGLISSPVFSVYMNTNDGGGQVVFGGANNTLLGGDIQYTDVLKSRGGYFFWDAPVTGVKIDGADAVSFDGAQAFTIDTGTNFFIAPSSFAEKVVKAALPDATESQQGYTVPCSKYQDSKTTFSLVLQKSGSSSDTIDVSVPISKMLLPVDKSGETCMFIVLPDGGNQFIVGNLFLRFFVNVYDFGKNRIGFAPLASGYENN

SEQ ID NO: 9938 - protein, 390 aa, Saccharomycopsis fibuligera
MLFSKSLLLSVLASLSFAAPVEKREKTLTLDFDVKRISSKAKNVTVASSPGFRRNLRAASDAGVTISLENEYSFYLTTIEIGTPGQKLQVDVDTGSSDLWVPGQGTSSLYGTYDHTKSTSYKKDRSGFSISYGDGSSARGDWAQETVSIGGASITGLEFGDATSQDVGQGLLGIGLKGNEASAQSSNSFTYDNLPLKLKDQGLIDKAAYSLYLNSEDATSGSILFGGSDSSKYSGSLATLDLVNIDDEGDSTSGAVAFFVELEGIEAGSSSITKTTYPALLDSGTTLIYAPSSIASSIGREYGTYSYSYGGYVTSCDATGPDFKFSFNGKTITVPFSNLLFQNSEGDSECLVGVLSSGSNYYILGDAFLRSAYVYYDIDNSQVGIAQAKY

SEQ ID NO: 9939 - protein, 491 aa, Amycolatopsis sp. HR167
MRNQGLGSWPVRRARMSPHATAVRHGGTALTYAELSRRVARLANGLRAAGVRPGDRVAYLGPNHPAYLETLFACGQAGAVFVPLNFRLGVPELDHALADSGASVLIHTPEHAETVAALAAGRLLRVPAGELDAADDEPPDLPVGLDDVCLLMYTSGSTGRPKGAMLTHGNLTWNCVNVLVETDLASDERALVAAPLFHAAALGMVCLPTLLKGGTVILHSAFDPGAVLSAVEQERVTLVFGVPTMYQAIAAHPRWRSADLSSLRTLLCGGAPVPADLASRYLDRGLAFVQGYGMTEAAPGVLVLDRAHVAEKIGSAGVPSFFTDVRLAGPSGEPVPPGEKGEIVVSGPNVMKGYWGRPEATAEVLRDGWFHSGDVATVDGDGYFHVVDRLKDMIISGGENIYPAEVENELYGYPGVEACAVIGVPDPRWGEVGKAVVVPADGSRIDGDELLAWLRTRLAGYKVPKSVEFTDRLPTTGSGKILKGEVRRRFG

SEQ ID NO: 9940 - protein, 503 aa, Neurospora crassa
MFIGGLNWETTDQSLRDYFSQFGEVVECTVMRDGATGRSRGFGFLTFKDPKTVNIVMVKEHYLDGKIIDPKRAIPRDEQEKTSKIFVGGVSQETTDHEFREYFAQFGRVVDATLMMDKDTGRPRGFGFVTFESEAGVEACLSANLEIHGKPIEVKKAQPRGNLREEAEEAARRGGGKFGQRRSGQQGGGMDDGSGQGGMNVMGGMGGAGTAGMTPQLMAQYLQRMQQAFQMMQQQMAMNRGMQNPMVQMMQMQQMQQMQQQMMAAQQAHAAAQAGAGQQGSGGRAGSVGAGQGPNAQNPQAMAAAMGMNPAMMQQMMGGAGGPGAGGADGGAGGPKGGFGGFDGQQGFDGQQRGPGGGNRGPRNDPAGGNYGGGMPGAGAGYNMGATSWEGMYDDVPQPMMGGPGFGPGMGGMGMGMGGGMGGGGGGGGRGGFHKGRGHHHGSGGGHQQGGHQGSHSPGGPVDPASAPPPNAPTGPKNAGKPGANYRGGGRGGSRGFHPYARG

SEQ ID NO: 9941 - protein, 442 aa, Candida albicans
MVNLLKKLHITKSHQSNHSNSDSNSLNSNTSMDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAEVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 9942 - protein, 360 aa, Oryza sativa
SAYWFNNSQELIDFKEGRHASFEYGRYGNPTTEALEKKMSALEKAESTVFVASGMYASVAMLSALVPAGGHVVTTTDCYRKTRIYMETELPKTKSQMTVIRPADMDALQNALDNNNVSLFFTETPTNPFLRCIDIDLVSKMCHSKGALLCIDSTFASPINQKALTLGADLVIHSATKYIAGHNDVIGGCISGRDELVSKVRIYHHVVGGVLNPNAAYLILRGMKTLHLRVQCQNNTAMRMAQFLEEHPKIARVYYPGLPSHPEHHIAKSQMTGFGGVISFEVAGDFDATRRFIDSVKIPYHAPSFGGCESIIDQPAIMSYWDSKEQREIYGIKDNLIRFSIGVEDFEDLKNDVVQALDKI

SEQ ID NO: 9943 - protein, 482 aa, Azospirillum brasilense
MANQRMLGFVHTAQRMPDKRPAAERRQDFAEIYARFSDERANEQANRCSQCGVPFCQVHCPVSNNIPDWLKLTSEGRLEEAYEVSQATNNFPEICGRICPQDRLCEGNCVIEQSTHGAVTIGSVEKYINDTAWDQGWVKPRTPSRELGLSVGVIGAGPAGLAAAEELRAKGYEVHVYDRYDRMGGLLVYGIPGFKLEKSVVERRVKLLADAGVIYHPNFEVGRDASLPELRRKHVAVLVATGVYKARDIKAPGSGLGNIVAALDYLTTSNKVSLGDTVEAYENGSLNAAGKHVVVLGGGDTAMDCVRTAIRQGATSVKCLYRRDRKNMPGSQREVAHAEEEGVEFIWQAAPEGFTGDTVVTGVRAVRIHLGVADATGRQTPQVIEGSEFTVQADLVIKALGFEPEDLPNAFDEPELKVTRWGTLLVDHRTKMTNMDGVFAAGDIVRGASLVVWAIRDGRDAAEGIHAYAKAKAEAPVAVAAE

SEQ ID NO: 9944 - protein, 468 aa, Streptococcus gordonii
  misc_feature (230)..(230): Xaa can be any naturally occurring amino acid
  misc_feature (239)..(239): Xaa can be any naturally occurring amino acid
MTKSLPKDFIFGGATAAYQAEGATHTDGKGPVAWDKYLEDNYWYTAEPASDFYHKYPVDLKLAEEYGVNGIRISIAWSRIFPTGYGEVNPKGVEFYHNLFAECHKRHVEPFVTLHHFDTPEALHSNGDFLNRDNIEHFVDYAAFCFEEFPEVRYWTTFNEIGPIGDGQYLVGKFPPGIQYDLAKVFQSHHNMMVSHARAVKLYKDKGYKGEIGVVHALPTKYPYDPENPXDVRAAELEXIIHNKFILDATYLGHYSDVTLAGVNHILKVNGGQLDLRDEDFAALEAAKDLNDFLGINYYMSDWMRDFDGETEIIHNGKGEKGSSKYQIKGVGRRESPTHIPKTDWDWIIYPQGLYDQIMRIKKDYPNYKKIYITENGLGYKDEFVDNTVYDDARIDYVKQHLEVLSDAIADGANVKGYFIWSLMDVFSWSNGYEKRYGLFYVDFETQERYPKKSAHWYKKLAETQMIE

SEQ ID NO: 9945 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 9946 - protein, 326 aa, Lycopersicon esculentum
LGANAILAVSLAVCKAGAAVKKIPLYKHIANLAGNKKLVLPVPAFNVINGGSHAGNKLAMQEFMILPVGASSFKEAMKMGCEVYHHLKAVIKKKYGQDATNVGDEGGFAPNIQENKEGLELLKTAIEKAGYTGKVVIGMDVAASEFYGKDKTYDLNFKEENNNGSQKISGDQLKDLYKSFVSEYPIVSIEDPFDQDDWETYAKLTAEIGQKVQIVGDDLLVTNPKRVAKAISEKTCNALLLKVNQIGSVTESIEAVKMSKQAGWGVMTSHRSGETEDTFIADLAVGLSTGQIKTGAPCRSERLAKYNQLLRIEEELGSDAVYAGAS

SEQ ID NO: 9947 - protein, 481 aa, Nicotiana tabacum
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKVEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 9948 - protein, 401 aa, Nicotiana tabacum
MAVKKSVGSLKEADLKGKRVFVRVDLNVPLDENFNITDDTRIRAAVPTIKYLMQHGSHVILASHLGRPKGVTPKYSLKPLVPRLSELLGVEVKIANDSIGPEVEKLVAEIPEGGVLLLENVRFYKEEEKNEPEFAKKLASLADLYVNDAFGTAHRAHASTEGVAKYLKPAVAGFLMQKELDYLVGAVANPQKPFAAIVGGSKVSSKIGVIESLLEKVDVLLLGGGMIFTFYKAQGYAVGSSLVEEDKLDLATSLMEKAKAKGVSLLLPTDVVIADKFAADANSKVVPASEIPDGWMGLDIGPDAIKSFGSALDTTKTVIWNGPMGVFEFDKFAAGTEAIAKKLAELSGKGVTTIIGGGDSVAAVEKVGLAEKMSHISTGGGASLELLEGKPLPGVLALDDA

SEQ ID NO: 9949 - protein, 287 aa, Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 9950 - protein, 207 aa, Lycopersicon esculentum
MASITKASLLILFLSLNLLFFAIVTATNTDCAFCPYHPPGSGGSGGGGSGSGGGGSGSGGGGGGSGSGGGGSGSGGGGSGSGGGGSGSGGGGSGTGGGGGSGGGGGGGGGGGGGGGGGGGGGGQVRCPRDALKLGVCANVLNLVNVVVGSPPTLPCCSLIQGLANLEVAACLCTAIRANILGLNLNVPLTLSLILNNCGMNNSGFTC

SEQ ID NO: 9951 - protein, 248 aa, Holcus lanatus
VFLGSAHGIAKVPPGPNITATYGDEWLDAKSTWYGKPTGAGPKDNGGACGYKDVDKPPFSGMTGCGNTPIFKDGRGCGSCFEIKCSKPESCSGEPVTVHITDDNEEPIAPYHFDLSGHAFGSMAKKGEEQKLRSAGELELKFRRVKCKYPDGTKPTFHVEKGSNPNYLALLVKYIDGDGDVVAVDIKEKGKDKWIELKESWGAVWRVDTPDKLTGPFTVRYTTEGGTKGEAEDVIPEGWKADTAYEAK

SEQ ID NO: 9952 - protein, 174 aa, Hordeum vulgare subsp. vulgare
MAPTVMASSATSVAPFQGLKSTAGLPVSRRSNASSASVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCQESGKA

SEQ ID NO: 9953 - protein, 475 aa, Marchantia polymorpha
MSPQTETKAGVGFKAGVKDYRLTYYTPDYETKDTDILAAFRMTPQPGVPAEEAGNAVAAESSTGTWTTVWTDGLTNLDRYKGRCYDIDPVPGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMLKRAACARELGVPIVMHDYLTGGFTANTSLAFYCRDNGLLLHIHRAMHAVIDRQKNHGIHFRVLAKALRMSGGDHIHAGTVVGKLEGDRQVTLGFVDLLRDDYIEKDRSRGIYFTQDWVSLPGVFPVASGGIHVWHMPALTEIFGDDSVLQFGGGTLGHPWGNAPGAVANRVSLEACVQARNEGRDLAREGNEIIREACKWSPELSAACEIWKEIKFEFDIIDTL

SEQ ID NO: 9954 - protein, 316 aa, Marchantia polymorpha
MSLMNWFEDKRRFGGLIGAFIEKATKGYIFSEREKDRYIKIDTTKGLWTRCDNCENMLYVRFLRQNKRICEECGYHLQMSSTERIELLIDRGTWYPMDEDMTARDVLKFSDEDSYKNRIAFYQKRTGLTDAIQTGIGQLNGIPIALGVMDFQFMGGSMGSVVGEKITRLIEYATRASMPLIIVCSSGGARMQEGTLSLMQMAKISSVLQIHQAQKRLLYIAILTYPTTGGVTASFGMLGDIIIAEPKAYIAFAGKRVIEQTLRQKIPDGFQVAESLFDHGLLDLIVPRNLLKGVLSEIFELYNAAPCKKFQNSFFK

SEQ ID NO: 9955 - protein, 394 aa, Spinacia oleracea
MASASLLKTSPVLDNPEFLKGQTLRIPSVAGVRFTPSGSSSLTVRASSYADELVKTAKTVASPGRGILAMDESNATCGKRLASIGLENTEANRQAYRTLLISAPGLGQYVSGAILFEETLYQSTTDGKKMVDVLIEQGIVPGIKVDKGWLPLPGSNDESWCQGLDGLACRSAAYYQQGARFAKWRTVVSIPNGPSALAVKEAAWGLARYAAITQDNGLDPILEPEIMLDGEHGIDRTFRVAQQVWAEVFFNLAENNVLLEGSSLKPSMVGPGALSARKGPPEQVADYPLKLLHRRRGPVVPGIMVLSGGQSEVEATLNLNAMNQSPNPWHVSFSYARALQNTCLKTWVEGQENVKAQDFACAKSNSLAQLGKYTGEGESEERKKDMFVKATLTY

SEQ ID NO: 9956 - protein, 1861 aa, Thermoanaerobacterium thermosulfurigenes
MNKKLFTNRFISFNMSLLLVLTAVFSSIPLHSVHAADNASVVANIVGEFQDQLGDSNWNIDSNITIMQYMGNGLYEFTTPTQLKAGSYQYKVALNHSWDGGGVPSQGNLTLNLANDSYVTFWFDYNTQSVTDSTKYTPIANDKLPRLVGTIQSAIGAGNDWKPETSTAIMTDDNFDNVYSYTAHVPKGDYQYKVTLGNTWDENYGANGVKDGSNIQINVTNDADITFYYDANTHNIWTNYSPILTGLDNNIYYDDLKHDTHDSFFRNPFGAVKVDQTVTLRIQAKNHDLESARISYWDDINKIRIELPMTRIGESPDGNFEYWEIKLSFDHPTRIWYYFILKDGTKTAYYGDNDDQLGGVGKATDTVNKDFELTVYDKNFDTPDWMKGAVMYQIFPDRFYNGDTSNDHAKTLSRGNDPIEFHNNWNDLPDNPNNAGTPGYTGDGIWSNDFFGDLKGIDDKLDYLKGLGVSVIYLNPIFESPSNHKYDTADYTKIDEMFGTTQDFEKLMSDAHAKGIKIILDGVFNHTSDDSIYFNRYGKYPGLGAYQAWKEGNQSLSPYGDWYTINSDGTYECWWGYDSLPVIKSLNGSEYNVTSWANFIINDENAISKYWLNPDGNLNDGADGWRLDVENEVAHDFWTHFRNAINTVKFEAPMIAENWGDASLDLLGDSFNSVMNYQFRNDIIDFLIGQSFDDGNGQHNPIDAAKLDQRLMSIYERYPLPAFYSTMNLLGSHDTMRILTVFGYNSADPNENSDAAKQLAEQKLKLATILQMGYPGMADIYYGDEAGVSGGKDPDDRRTFPWGNEDTTLQDFFKNISSIRNNNQVLKTGDLETLYAQNDVYAIGRRIINGKDAFGTSYPDSAAIVAINRSKSDKQIAIDTTKFLRDGVTFKDLINNNVSYSISNGQIVIDVPAMSGVMLISDDGQDLTAPQAPSNVVVTSGNGKVDLSWLQSDGATGYNIYRSSVEGGLYEKIASNVTETTFEDANVTNGLKYVYAISAIDELGNESGISNDAVAYPAYPIGWVGNLTQVSDNHIIGVDKPTEDIYAEVWADGLTNSTGQGPNMIAQLGYKYVSGTVYDSVYGSVYNSVYGVDDSGFTWVNAQYVGDIGNNDQYKASFTPDKIGQWEYLMRFSDNQGQDWITTSTLSFYVVPSDDLIKPTAPYLNQPGTESSRVSLTWNPSTDNVGIYDYEIYRSDGGTFNKIATVSNEVYNYIDTSVINGVTYNYKVVAVDLSFNRTESNVVTIKPDVVPIKVIFNVTVPDYTPDAVNLAGTFPNATWDPSAQQMTKIDNNTYSITLTLDEGTQIEYKYARGSWDKVEKDEYGNEFASNRKVTIVNQGNNEMTINDTVYRWRDIPIFIYSPSSNMTVDSNISTMEVKGNTYKGAKVTINGDSFVQDKNGVFTKDVSLNYGVNKIKIHVEPNDGSVYGNDQGRITELTKDIEIDVIRQENNSGSGTGNNNTSTSGSNSSSTGSGSTGSTSITSNISNTSNTSNTIGVITKNGNVITLTLDAGKAKDLIVNSKDKKVVFDITTIGEGQQKVVQISKDILDTSAANGKDIVIKSDNASIALTKDALNQNQIQNGVNVSIKDNGKPNVTNYVSLSNVVDITISGISGNVTLAKPVEVTLNISKANDPRKVAVYYYNPTTNQWEYVGGKVDASSGTITFNATHFSQYAAFEYDKTFNDIKDNWAKDVIEVLASRHIVEGMTDTQYEPNKTVTRAEFTAMILRLLNIKDETYSGEFSDVKSGDWYANAIEAAYKAGIIEGDGKNARPNDSITREEMTAIAMRAYEMLTQYKEENIGATTFSDDKSISDWARNVVANAAKLGIVNGEPNNVFAPKGNATRAEAAAIIYGLLEKSGNI

SEQ ID NO: 9957 - protein, 337 aa, Petroselinum crispum
ILSPFKFSRRATGDNDVRFKVLYCGVCHSDLHMVKNEWGMTTYPIVPGHEIVGRVTEVGSKVEKFKVGDAVGVGCLVGSCLSCENCDDDSENNCAKQVQTYAFTNVDGSITYGGYADSMVADQHFVLRWPENLPLDSGAPLLCAGITTYSPLRYHGLDKPGTKVGVVGLGGLGHVAVKMAKAFGAHVTVISTSESKKQEALEKLGADEFLVSSDSDQMQAATGTLHGIIDTVSALHPVVPLLGLLKVNGKLVMVGAPEKPLELPVFPLLMGRKVLAGSNIGGLKETQEMLDFAAQHNITADVEVIPVDYVNTAMERLVKSDVRYRFVIDVANTIKTE

SEQ ID NO: 9958 - protein, 473 aa, Cynara cardunculus
LKKRKVNILNHPGEHAGSNDANARRKYGVRGNFRDSDGELIALKNYMDAQYFGEIGIGTPPQKFTVIFDTGSSNLWVPSSKCYFSVACLFHSKYRSTDSTTYKKNGKSAAIQYGTGSISGFFSQDSVKLGDLLVKEQDFIEATKEPGITFLAAKFDGILGLGFQEISVGDAVPVWYTMLNQGLVQEPVFSFWLNRNADEQEGGELVFGGVDPNHFKGEHTYVPVTQKGYWQFEMGDVLIGDKTTGFCASGCAAIADSGTSLLAGTTTIVTQINQAIGAAGVMSQQCKSLVDQYGKSMIEMLLSEEQPEKICSQMKLCSFDGSHDTSMIIESVVDKSKGKSSGLPMRCVPCARWVVWMQNQIRQNETEENIINYVDKLCERLPSPMGESAVDCSSLSSMPNIAFTVGGKTFNLSPEQYVLKVGEGATAQCISGFTAMDVAPPHGPLWILGDVFMGQYHTVFDYGNLRVGFAEAA

SEQ ID NO: 9959 - protein, 382 aa, Haemophilus influenzae
MAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 9960 - protein, 1028 aa, Haemophilus influenzae
MQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTCHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDKDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWRNFGESNNVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 9961 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 9962 - protein, 281 aa, Shigella flexneri
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGFAMNPARDFGPKVFAWLAGWGNVAFTGGRDIPYFLVPLFSPIVGAIVGAFAYRKLIGRHLPCDICVVEEKETTTPSEQKASL

SEQ ID NO: 9963 - protein, 369 aa, Haemophilus influenzae
MTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTASASAIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKAQPQVESVLYPNKGGMLSFRLQDEAWVNTFLKSIKLITFAESLGGTESFITYPATQTHMDIPESERVARGITNTLLRFSVGIEDVEDIKADLLQAFANLK

SEQ ID NO: 9964 - protein, 496 aa, Escherichia coli
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHAGKAPVRTMVDILYRGEHRIANIVMTLAAATALWFCFAGNLQNAAIVAVLGLLCAAIFISFMVQSAGKRWPTGVMLMVVVLFAFLYSWPIQALLPTYLKTDLAYNPHTVANVLFFSGFGAAVGCCVGGFLGDWLGTRKAYVCSLLASQLLIIPVFAIGGANVWVLGLLLFFQQMLGQGIAGILPKLIGGYFDTDQRAAGLGFTYNVGALGGALAPIIGALIAQRLDLGTALASLSFSLTFVVILLIGLDMPSRVQRWLRPEALRTHDAIDGKPFSGAVPFGSAKNDLVKTKS

SEQ ID NO: 9965 - protein, 429 aa, Escherichia coli
MKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 9966 - protein, 363 aa, Aspergillus flavus
MQLLQSSVIAATVGAALVAAVPVELEARDSCTFTSAADAKSGKTSCSTITLSNIEVPAGETLDLTGLNDGTTVIFSGETTFGYKEWEGPLISVSGTNIKVQQASGAKIDGDGSRWWDGKGGNGGKTKPKFCYVHKLDSSSITGLQIYNTPVQGFSIQSDNLNITDVTIDNSAGTAEGHNTDAFDVGSSTYINIDGATVYNQDDCLAINSGSHITFTNGYCDGGHGLSIGSVGGRSDNTVEDVTISNSKVVNSQNGVRIKTVYDATGTVSNVKFEDITLSGITKYGLIVEQDYENGSPTGTPTNGIKVSDITFDKVTGTVESDATDIYILCGSGSCTDWTWSGVSITGGKTSSKCENVPTGASC

SEQ ID NO: 9967 - protein, 366 aa, Aspergillus flavus
MHFQLLVLAPLALSSAAAPAPSRTSELVERGSSCTFTSAAQASASAKSCSNIVLKNIAVPAGETLDLSKAKDGATITFEGTTTFGYKEWKGPLIRFGGNKITVTQAAAVIDVQGSRWWDGKGPNGGKTKPKFIQYPQLESPTITGLHVKNSPVQVFSVQGNDVHLTDITIDNSDGDNNGGHNTDAFDVSESNGVYITGANVKNQDDCLAINSGENIEFTGATCSGGHGISIGSIGNRDTNTVKNVKVADSTVVDSDNGIRIKTISGATGSVSGVTYENITLKNIKKNGIVIELDYKNGGPTGKPTTGVPITDLTVNGVTGSVASKATPVYILCGKGSCSDWTWKGVSISGGKKSDKCQNIPSGASC

SEQ ID NO: 9968 - protein, 475 aa, Stellaria media
MSPQTETKASVGFKAGVKDYKLTYYTPEYQTLDTDILAAFRVTPQPGVPPEEAGAAVAAESSTGTWTTVWTDGLTSLDRYKGRCYHIDPVPGEENQYICYVAYPLDLFEEGSVTNMFTSIVGNVFGFKALRALRLEDLRIPVAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGMHFRVLAKALRLSGGDHIHAGTVVGKLEGEREITLGFVDLLRDDFTEKDRSRGIYFTQSWVSTPGVLPVASGGIHVWHMPALTEIFGDDSVLQFGGGTLGHPWGNAPGAVANRVALEACVQARNEGRDLAREGNTIIREACKWSPELAAACEVWKEIKFEFQAMDTI

SEQ ID NO: 9969 - protein, 426 aa, Phalaenopsis sp. SM9108
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 9970 - protein, 332 aa, Synechococcus elongatus PCC 7942
DPPLLWAIDSDPVLAGTKLIAEAWDAAGLYQVGTFIGDRFGTWNGPFRDDIRRFWRGDQGCTYALSQRLLGSPDVYSTDQWYAGRTINFITCHDGFTLRDLVSYSQKHNFANGENNRDGTNDNYSWNYGIEGETDDPTILSLRERQQRNLLATLFLAQGTPMLTMGDEVKRSQQGNNNAYCQDNEISWFDWSLCDRHADFLVFSRRLIELSQSLVMFQQNELLQNEPHPRRPYAIWHGVKLKQPDWALWSHSLAVSLCHPRQQEWLYLAFNAYWEDLRFQLPRPPRGRVWYRLLDTSLPNLEACHLPDEAKPCLRRDYIVPARSLLLLMARA

SEQ ID NO: 9971 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 9972 - protein, 268 aa, Arabidopsis thaliana
MAAAANTSAVFASPSQPLSSKRSFLYSSRIGPILRRFPRKKLDLQVKAVATTLAPLEEIKEYKLPSWAMFEMGTAPVYWKTMNGLPPTSGEKLKLFYNPAASKLTLNEDYGVAFNGGFNQPIMCGGEPRAMLKKDRGKADSPIYTMQICIPKHAVNLIFSFTNGVDWDGPYRLQFQVPKRRQNKPIEFFNEGLANELSQDGACERAIFPDSNVVPTRCKMIANLTVEGGDRCNLDLVPGCMDTNSEHFNPYANVDDGSCPLELSDSDE

SEQ ID NO: 9973 - protein, 313 aa, Pyrus communis
MATFPVVDLSLVNGEERVATLEKINDACENWGFFELVNHGMSTELLDTVEKMTKDHYKKTMEQRFKEMVAAKGLDAVQSDIHDLDWESTFFLRHLPSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGDWVDVPPMHHSIVINLGDQIEVITNGKYKSVMHRVIAQSDRDRMSIASFYNPGDDAFISPAPAVLEKKTEDAPTYPKFVFDDYMKLYSGLKFQAKEPRFEAMKAKESTLVATT

SEQ ID NO: 9974 - protein, 244 aa, Saccharomyces cerevisiae
INHNFFTEITSSISDIKFSPNGRYIASRDYLTVKIWDVNMDNKPLKTINIHEQLKERLSDTYENDAIFDKFEVNFSGDSSSVMTGSYNNNFMIYPNVVTSGDNDNGIVKTFDEHNAPNSNSNKNIHNSIQNKDSSSSGNSHKRRSNGRNTGMVGSSNSSRSSIAGGEGANSEDSGTEMNEIVLQADKTAFRNKRYGSLAQRSARNKDWGDDIDFKKNILHFSWHPRENSIAVAATNNLFIFSAL

SEQ ID NO: 9975 - protein, 158 aa, Triticum turgidum subsp. durum
MEYQGQQQHGQAATNRFAEYGNLVAGHGAGTGMAAHGGVGTGAVAAAGGHFQPTREEHKAGGILQRSGSSSSSSSSEDDGMGGRKKKGIKDKIKEKLPGGHGDQQQTAGTYGQQGHTGTAGTGGTYGQPGHTGMAGTDSTGEKKGIMDKIKEKLPGQH

SEQ ID NO: 9976 - protein, 150 aa, Triticum turgidum subsp. durum
MEFQGQHDNPANRVDEYGNPFPLAGGVGGGHAAPGTGGQLQARRGEHKTGGILHRSGSSSSSSSSEDDGMGGRRKKGMKEKIKEKLPGGHKDNQQHMATGTGTGGAYGPGTGTGGAYGQQGHAGMAGAGTGTGEKKGIMDKIKEKLPGQH

SEQ ID NO: 9977 - protein, 222 aa, Schizosaccharomyces pombe
MWRPLENTPEVLEPYLQKIGVQDASVFDLFSLEEIPEYIPRPVHALLFVFPSSGTKTIYKGSRILPKDSDKVLWYPQTIPNACGTIGLLHAVSNGELRRKVNENDFIKSLIRTAEGSSIEERAKLIEDSKELEALHAAFAGPPLEVEGSEEDVETDLHFICFVKGKSKDDNHFYELDGRQEGPVQHSEIESDLLNAEVLSVIKNYIQSIDSPFFSLVAITTP

SEQ ID NO: 9978 - protein, 484 aa, Schizosaccharomyces pombe
MIDSTSTATATSKTVELNTNGSKTDASSENGTASNYPEGLWCFDEAMKMDPETTVKLQLDHLNKLRTVHGHARNFVKADNSRFVDEKGTEHLDLIGGVGVVTVGNNNQYVWDCLQKCFDAKLYMMGAISYRNLAAAFGRNMALLSPGQKLTRTWTATGGAEANEGVIKLIRLATRYKPNKKKFLSTLNSFHGKTTGAVFLGGKEKWQKYQSPAPFDVDYVPYGDAEALQVALSSGMYRSFIVEPIQGEGGVIVPPPGYLAKARELCTKYDTYLVLDEIQTGCGRTGKFWACEYENIIPDCIAFAKGFSGGLIPFAGYIATEELWNAAYNSLETAFLHTATYQENTLGLAAGVATIDYIVQNDLLSRCRKLGGIMFDRLNKLQTKFPHVMKDVRGRGMIVGIEFYPIPESVQEEFGEYYATPIVNDLADTYHVQVYCSLNNPSVFRFLPPLTIPEADLDEGLSAVESAVAKFDAKVKEAVAAKST

SEQ ID NO: 9979 - protein, 362 aa, Schizosaccharomyces pombe
MSKEETLYSVKVDQERVPLFDEDFYKGFRSELSVRFTMAALDPRAKSNDAVTVNVITRLEHPEEDGEESDEELFQEEKFTLCTLKKGSVYQQPIDIIFSPGEEVFFERVGGDIPVYLSGTCIITNIPEEEDSSDLENDFLYGADEFSSDEEEMDDISVTSSEEEEEENGARIEELNSDEEDAEQAEEEILEKPVPKDEVAEKHSKDKLKKEEKEKKTAVDVSDSVNGKKRKTEPAGEGEQTEKKSKSTKTYPKQVLEGNVTVQDKVKGDGPAAKRKKRVSMRYIGRLTNGKVFDKNITGKPFTFNLGLEEVIKGWDVGIVGMQVGGERTIHIPAAMAYGSKRLPGIPANSDLVFDVKLLAVN

SEQ ID NO: 9980 - protein, 450 aa, Schizosaccharomyces pombe
MLVLKLLLWSIISGLSLAEQVWRNSNAIRTIDLRSTYTKTLTSLIIVNEGDEPQNTYRYFQQTSPGESVLSLSVSIKEEEKKGTNPIKVNNNVYDIPLQPPVKPGESRTLLIQAGLDGGVRPLPAAVDQDEEQYLVYLTTLYLDSPYTTDLQRTRLILPSAKIDTYTTYNIDGAELPNRVGNTLVYESRETITGEDNDLGEIYVRYEHTVPIPRGADLYVQIDMHEYRKMLEVSERVVFENHAAKLKSNFDRAKWYMGNFYNPVSTAINRVVYSLPRNSKDVYYTDEVGNITTSHMRVEPHQTWIELNPRYPVFGGWNYLFQLDWKMPYEEFRSSKNRREYLDIPLAWSPGDMIYEKAVWSYVFPEGATNIEIEMPVEISNSNVTKIHKFLDTLGRQVFTYEALNVTDGVPSDIVHISYEYNSSAFFLRIAIITTLLILLAAAAYMIWAP

SEQ ID NO: 9981 - protein, 320 aa, Cucumis melo
MEMDFPVINMNNLNGESRVSVLNQINDACENWGFFELVNHGISHELMDKVEKLTKEHYRKCMEQRFKEMVASKGLDSVETEINDTDWESTFFLRHLPVSNMSEIGDLDEEYKKVMKEFADELEKLAEEVLDLLCENLGLEKGYLKKVFYGSKGPNFGTKVSNYPPCPKPELIKGLRAHTDAGGLILLFQDDKVSGLHVLKDGKWVDVPPMHHSIVINLGDQLEVITNGKYKSVMHRVIAQEDGNRMSIASFYNPGNDAVIYPAPALVEGEQEKTKLYPKFVFDDYMKLYVGLKFQAKEPRFEAMKAMESTNLNMGPIATV

SEQ ID NO: 9982 - protein, 392 aa, Schizosaccharomyces pombe
MATPVDTEYYDLLGISTDATAVDIKKAYRKLAVKYHPDKNPDDPQGASEKFQKISEAYQVLGDEKLRSQYDQFGKEKAVPEQGFTDAYDFFTNLFGGAPFREWVGELSFVKEMFREEDSAVEQGQMNDKQQLLLESSEPTPTIKQQFNDRKKNAQIREREALAKREQEMIEDRRQRIKEVTENLEKRLDDWIAKATTEEGLNALREKYTQEANTLRIESFGVEILHAIGEVYTQKGRTVLKSSKFGIGGFWSRMKEKGKIARATWDTVSAAMDAKLSIDQMQKLEDKGEDQASAEERAKLELDITGKILRASWCGARYDIQGVLREACSNLLKKRVPTELRLKRAHALLEIGTIFSNVEADPDDPNRIFENLILENKKKRKKGSEAKPPKAT

SEQ ID NO: 9983 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTAVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 9984 - protein, 317 aa, Vigna radiata
MTSIPSHMRAWIYSEYGNIEEVLKFDPNVPTPHLMENQVLIKVVAAAINPVDYKRALGHFKDIDSPLPTAPGYDVAGVVVKVGNQVKKFQVGDEVYGDINEVTLDHPKTIGSLAEYTAVEEKVLAHKPSNLSFVEAASLPLAIITAYQGLETAQFSVGKSILVLGGAGGVGSLVIQIAKHIFGASKIAATGSTGKLELFENLGTDLPIDYTKENFEELAEKFDVVYDAVGQSERALKSVKEGGKVVTIVAPATPPAIPFLLTSDGDLLEKLRPYLENGQVKPILDPKSPFPFSQTVEAFSYLKTNRATGKVVIYPIP

SEQ ID NO: 9985 - protein, 512 aa, Nicotiana tabacum
MTIHLLYFHANRGQENSMERWWFNSMLFKKEFERRCGLNKSMGSLGPIENTNEDPNRKVKNIHSWRNRDNSSCSNVDYLFGVKDIRNFISDDTFLVSDRNGDSYSIYFDIENHIFEIDNDHSFLSELESSFYSYRNSNYRNNGFRGEDPYYNSYMYDTQYSWNNHINSCIDSYLQSQICIDTSIISGSENYGDSYIYRAVCGGESRNSSENEGSSRRTRTKGSDLTIRESSNDLEVTQKYRHLWVQCENCYGLNYKKFLKSKMNICEQCGYHLKMSSSDRIELLIDPGTWDPMDEDMVSLDPIEFHSEEEPYKDRIDSYQRKTGLTEAVQTGIGQLNGIPVAIGVMDFQFMGGSMGSVVGEKITRLIEYAANQILPLIIVCASGGARMQEGSLSLMQMAKISSALYDYQLNKKLFYVSILTSPTTGGVTASFGMLGDIIIAEPNAYIAFAGKRVIEQTLNKTVPEGSQAAEYLFQKGLFDLIVPRNLLKSVLSELFKLHAFFPLNQKSSKIK

SEQ ID NO: 9986 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAQQTPLSALYAAKLIKEAPFPAGVINVISGFGRTAGAAISSHMDIDKVAFTGSTLVGPTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDVAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 9987 - protein, 185 aa, Odontella sinensis
MKRFNFLILLSTVLISLFPNRALADIGGLTKCSESPAFEKRLKASVKKLEQRMGKYEAGSPPALALQQQIERTQARFDKYSRSELLCGTDGLPHLIADGRWSHAAEFILPGFGFIYISGWIGWVGRKYLRAVSTTKNPTESEIIINVPLALKIMTTGYIWPISAWQEFISNDLVALDEEVTVSPR

SEQ ID NO: 9988 - protein, 179 aa, Odontella sinensis
MSNFIDKTFTVIADILLKVLPASKQEKQAFSYYRAGMSAQSEGKYAEALENYYEALQLEEDPYDRSYTLYNIGLIYGNNGNYSQALEYYHQALELNSNLPQALNNIAVIYHSQGLNALQMQNQDKNLEIRNDEYLELAKEFFDKAAEYWRQALKLAPDNYPGAQNWLKVTGRQISEEYF

SEQ ID NO: 9989 - protein, 452 aa, Lactobacillus sanfranciscensis
MKVIVVGCTHAGTFAVKQTIADHPDADVTAYEMNDNISFLSCGIALYLGKEIKNNDPRGLFYSSPEELSNLGANVQMRHQVTNVDPETKTIKVKDLITNEEKTEAYDKLIMTTGSKPTVPPIPGIDSSRVYLCKNYNDAKKLFEEAPKAKTITIIGSGYIGAELAEAYSNQNYNVNLIDGHERVLYKYFDKEFTDILAKDYEAHGVNLVLGSKVAAFEEVDDEIITKTLDGKEIKSDIAILCIGFRPNTELLKGKVAMLDNGAIITDEYMHSSNRDIFAAGDSAAVHYNPTNSNAYIPLATNAVRQGRLVGLNLTEDKVKDMGTQSSSGLKLYGRTYVSTGINTALAKANNLKVSEVIIADNYRPEFMLSTDEVLMSLVYDPKTRVILGGALSSMHDVSQSANVLSVCIQNKNTIDDLAMVDMLFQPQFDRPFNYLNILGQAAQAQADKAHK

SEQ ID NO: 9990 - protein, 342 aa, Lycopersicon esculentum
MGVDYYKVLGVDKNATDDDLKKAYRKLAMKWHPDKNPQNKKEAEAKFKQISEAYDVLSDSQKKAVYDQYGEEGLKGGVPPPGAGGPGAGSTYFSTGDGPTSFRFNSRNADDIFAEFFGFSTPYGPGGGRGSRFGNMFTDDIFAASFGEGGGGGGVPMHSSVPRKEAPVQQNLPCNLEDLYKGTTKKMKISREIADSSGKRIVQEILTIEIKPGWKKGTKITFQEKGNEQPGVIPADLVFIIDEKPHKVFSRDGNDLIVTQKIPLAEALTGTTVQLTTLDGRNLTIPINNVIQPNYEHIAPGEGMPLPKDPSKKGNLRIKFDIKFPARPTVAQKSGIKKLLGS

SEQ ID NO: 9991 - protein, 355 aa, Oryza sativa
MRGKKPHKELKLSVPAQETPVDKFLTASGTFKDGELRLNQRGLQLISEETADEPQSTNLKVEDVQLSMDDLEMIQVIGKGSGGIVQLVRHKWVGTLYALKGIQMNIQEAVRKQIVQELKINQATQNAHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCAFISSCIQKDPAERMSASELLNHPFIKKFEDKDLDLRILVESLEPPMNISE

SEQ ID NO: 9992 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 9993 - protein, 496 aa, Cucurbita maxima
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 9994 - protein, 181 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYIGV

SEQ ID NO: 9995 - protein, 475 aa, Azadirachta indica
MSPQTETKASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 9996 - protein, 384 aa, Pseudomonas viridiflava
MVKPSLFSANKLASAVVASLLFASAGAQADIATDVATTGWATQNGGTKGGSKAAANNIYTVKNAAELKAALKASVGTNGRIIKISGVIDVSEGNAYTKTADMKARGRLDIPGKTTIVGITNNAEIREGFFYAKENDVIIRNLTIENPWDPEPIWDANDGSAGNWNSEYDGLTIEGANNVWVDHVTFTDGRRTDDQNGTANGRPKQHHDGALDVKNGANYVTISYTAFKSHEKNNLIGSSDSRTTDDGKLKVTIHNSLFENISARAPRVRFGQVHLYNNYHVGSASHSVYPFSYAHGVGKSSKIFSEKNAFEISGISGCTKIAGDYGGSVYRDSGSTLNGTALTCTWSSSIGWTPPYSYTPLNADKVKADVTAKAGAGKIDSRGS

SEQ ID NO: 9997 - protein, 475 aa, Amycolatopsis mediterranei
MSPREVVIVGYGMAGARLADEIRRRDPIAERVRLTVLGAEKHAAYNRVLLSAVVAGGMSAESVRLHDDEWAQRHNIDLRLGVDVARIDREKRCVELADGSSIDYDALVLATGANPWIPPVEGLEAGPGVVAFRSLDDCAKILDAARFGAPVAVLGGGLLGLEAARGLAGRGNQVTVVHPLGHVMERQLDPAAGHVLARQLTDMGVTFKFGATAARYLPGDGLKLDDGSLVPADLVVVAAGVRAETSLAVEAGLDVDLGILVDDTLRTSDGRIHALGDCARHPGAPAGLIQPAWEQASVLADVLTGTNAAARYRGTTAVTRLKARGIDLAALGETQLDAGNPNVEVLTFNDPTGGRYGKLVVRENRVTGAILLGLPDAAATITQFHDRGTLLPEDRLGVLLGRALPTGATPAASPADLPAAAVICRCNNVTKGRLIEAWKAGATDTPALARATRATTGCGGCSDTVGGIANWLAAQ

SEQ ID NO: 9998 - protein, 294 aa, Petroselinum crispum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRITGTPNEDTWPGVTSLPDFKSAFPKWPSKELETVVPNLDSAGLNLLKKMLCLDPSRRITARIALEHEYFKDIGIVP

SEQ ID NO: 9999 - protein, 377 aa, Xanthomonas campestris
MKPKFSTAAAASLFVGSLLVVGVACADPALEVATTGWATQNGGTKGGSKAAAANIYTVKTAAELKSALKASVGSNGRIIKISGIIDVSEGKPYTTTSDMKSRARLDIPTKTTLIGITSNAEIREGYFYVKANDVIIRNITIENPWDPEPVWDPDDGSAGNWNSEYDGLTVEGATNVWVDHVTFTDGRRTDDQNGTANGRPKQHHDGAMDVKKGANFVTISYSAFKSHEKNDLIGSSDSASSTDSGKLKVTIHNTLFENISARAPRVRFGQVHLYNNYHVGSTSNKVYPFSHAHGVGKESKIFSERNVFDISGVSSCDKIAADYGGSVYRDQGSLLNGKALTCSWNSNIGWTPPYTYSLLSADKVAADVKAKAGAGKL

SEQ ID NO: 10000 - protein, 417 aa, Arabidopsis thaliana
GINVQTGEEVALKLEPVKTKHPQLHYESKVYMLLQGGTGVPHIKWFGVEGNYNCMAIDLLGPSLEDLFNYCTRSFSLKTVLMLADQLINRVEYMHSRGFLHRDIKPDNFLMGLGRKANQVYIIDYGLAKKYRDLQTHKHIPYRENKNLTGTARYASVNTHLGIEQSRRDDLESLGYVLMYFIRGSLPWQGLKAGTKKQKYEKISEKKMLTPVEVLCKSYPSEFTSYFHYCRSLRFEDKPDYSYLKRLFRDLFIREGYQFDYVFDWTILKYPQSGSISKPRPNPKPALDPPGPSAERNEKPIVGQDLRERFSGAVEAFARRNVPSHGIRPKHIFSDDASKEVQVSEKTRNEIATKMAVMSSSQPGSSGELSENRSSKLFSSSAQKIQPVQETKLSARLGRDDGLRSFDMLTIGSGKRK

SEQ ID NO: 10001 - protein, 465 aa, Yersinia enterocolitica (type 0:8)
MLLPVIMAGGAGSRLWPLSRTHYPKQFLALTSELSMFQETLLRLEISPHLSPLVICNAEHRFIIAEQLRQQNLLHSGIVLEPIGRNTAPAIALAALLATSNGEDPILLVLAADHVIQDKPAFISAIQLAEPLAEMGKLVTFGIVPNTPETGYGYIRQGKQIEGGAFQVDSFVEKPDLAKAEQYLSSGDYYWNSGMFVFKASRYLQELEKHRPDIFEACKSAIADNGKDLDFIRLDEAAFYSCPDESIDYAVMERTSDAVVVPMNAQWSDVGCWSALWEINDKDSHGNVVRGDVLTEDTNNSYIYSQNRLVATVGINDLIIVETKDALLVANKNKVQSVKEIVGQLKLGSRLEYLQHKEVYRPWGSHDAIAEGVRYHVQHVTIKPGQRTATQIHHHRAEHWVVVSGTARVYRDNESYLVTENESTYIAVGVAHSIENPGKLPLEIIEVRTGSYLEEDDIVRIEHKI

SEQ ID NO: 10002 - protein, 175 aa, Triticum aestivum
MAPAVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10003 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10004 - protein, 173 aa, Triticum aestivum
MAPAVMASSATTVAPFQGLKSTAGLPVSRRSSEPRPRHNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVNGFDNLRQVQCVSFIAFRPPGCEESGKA

SEQ ID NO: 10005 - protein, 175 aa, Triticum aestivum
MAPAVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 10006 - protein, 388 aa, Synechococcus sp. WH 8103
TTAFHSPTSRRRKTLQEANLLEGPLMLIKSIRGFSSNRAMTWLACAPLALMGLGIFTLSAKAEELPDLNAAFLANNLWLLVATILVIFMNAGFAMVEAGMCRQKNAVNILAKNLFVFALAVTAYWFVGYSFMYGDAAIDGWLYFGGLFFDPTVTAETISDAGLVPTVDFLFQAAFAGTAATIVSGLVAERIKFGEFVVFALILTAFIYPVAGSWEWNGGWLNSVGNAEFIDFAGSSIVHSVGAWAGLVGAALLGPRIGKYVGGKVQAIPGHNMSIATLGALILWIGWYGFNPGSQLAMDQWVPYVAVTTTLGAAGGAIGATVISTITSKKPDLTMIINGILAGLVSVTAGCGNLTLTGSWVAGLVGGIIVVFSVSALDSAGIDDPVGA

SEQ ID NO: 10007 - protein, 455 aa, Blumeria graminis
MPGQSTPRARPSPQLKLSTPKKSSHTPLELQQTHHLVDRHGISISNIQSAGGGSESSEAHSRSGSFGLLDGRGSVPVSAGSQYSALSFAQNGLRHLQGTPDPSSAVGSLYSERSEIGVGVERDGSLNELDSFARLSLERARTLDVEELDDEGWRIASTENRIQELSSLGEGAGGAVTKCILRGGKTIFALKIITTNPDPDVKKQIVRELGFNKDCANEHICRYYGAFVEPSTATISIAMEFCEGGSLDSIYREVRKLGGRTGEKVLGKIAEGVLNGLTYLHGKKIIHRDIKPSNILLCRDGQVKLCDFGVSGEFGTKGDANTFIGTSYYMAPERITGQSYTITSDVWSTGVTLLEVAQHRFPFPADGTEVQPRAGLIDLLTYIVRQPVPKLKDEPEAGIKWSDNFKYFIECCLEKTPSRRASPWRMLEHPWMIEMQSKRVHMAHFLATVWGWEEK

SEQ ID NO: 10008 - protein, 199 aa, Oryza sativa (indica cultivar-group)
MGCSSSVPARSTGGLNNISNDNSATDSKDLRAKLVLLGDSGVGKSCIVLRFVRGQFDPTSKVTVGASFLSQTLALEDSTIVKFEIWDTAGQERYAALAPLYYRGAAAAVVVYDITSPESFSKAQYWVKELQKHGSPDIIMVLVGNKADLHENRHVSSQEAQEYAEKNNMVFIETSAKTADNINQVFEEIAKRLPRPTAS

SEQ ID NO: 10009 - protein, 308 aa, Hordeum vulgare subsp. spontaneum
MATAGKVIKCKAAVAWEAGKPLSMEEEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCSISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10010 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEDVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTLAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10011 - protein, 306 aa, Hordeum vulgare subsp. spontaneum
MATAGEVIKCKAAVAWEAGKPLSMEEVEVAPPQAMEVRDKILYTALCHTDVYFWEANGQTPVFPRILGHEAGGIVESVGKGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTSNADAMISAFECVHDGWGVAHKEAVFKTHPMNFL

SEQ ID NO: 10012 - protein, 306 aa, Hordeum vulgare subsp. spontaneum
MATAGKVIKCKAAVAWEAGKPLSMEEVEVAPPQAMEVRDKILYTALCHTDVYFWEAKGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10013 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10014 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVTKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10015 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLYDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 10016 - protein, 304 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLGINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAWRTRSRCSRPTP

SEQ ID NO: 10017 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 10018 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 10019 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 10020 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 10021 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAVMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 10022 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 10023 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAQKEAVFKTHPMNFL

SEQ ID NO: 10024 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTANSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 10025 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 10026 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRYEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRI

SEQ ID NO: 10027 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDVVPGATDVVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 10028 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 10029 - protein, 480 aa, Salmonella enterica subsp. indica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLSCPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 10030 - protein, 464 aa, Salmonella enterica subsp. enterica
MSNIILPVVMAGGAGSRLWPLSRALYPKQFLSLTSTNSMLQETIIRLEGIEHEYPLFICNEEHRFIVAEQLRQLSIDHSGIILEPDGRNTGPAIALAAFHALNNGYDPVMLVLAADHEIQERKNFIDSIEIAKQFAENDKLVTFGIVPASPETGYGYIKVGEKIGPDGYKVAAFVEKPHRLLAEEYINSGKYLWNSGMFMFKASVFLNELKKFRPDIYSICETSLLKSESDLDFIRVNGKVFNCCPSESIDYAVMENTMQAVVVPLDAKWSDVGSWTALWDISKKNENGNIIRGDVIAKDTDNCYLHSESRLIGTVGVKDLVIVETKDAVLVAHKNNVQDVKNIVEQLKIQNRQEYLHHREVYRPWGSHDAVADGERFRVKHVTVLPGHAISKQVHYHRAEHWVIVSGTARVYIGDENFLLGENESTFIPVGTVHSIENPGKIPLEIIEVQSGTYLHEDDVERS

SEQ ID NO: 10031 - protein, 476 aa, Escherichia coli
MAKYNINPVILCGGNGTRLWPLSRGLYPKQFLNLDDTSSMLEKTINRLEGLDVSLPLVICNEQHRFIVAEQLRTLKKLNRNILLEPIGKNTAPALALAALYNINFNSNSLLLVLAADHVINDNQSFVTSIKKAIPYAIEGKLVTFGIEPTKPETGYGYIKKGNECSSIAIGDGYHVERFVEKPNFSSACDYISSGEYLWNSGMFLFEPHKYLSELRKYQPDIYNACVDAFKYDLIDNDFIRVDPLSFSQSPSLSVDYAVMEKTSDAVVVPMNAEWSDVGSWAALWEISNKDDDGNVLHGDVISLSTKNSYIYSESELVTTIGIENLAIVQTKDAILVSNLASTQDVKKLVEILQLNGRTEHYVHQERYRPWGKSDTIDTGDSYQVKMLTIMPRENLSMQVHYKRAEHWVVLSGCARIVIDGFESILNENESVHIPVGVKHYLENIGNTPLRIIEIRSGSYLEEDDIIRFSDNDGYV

SEQ ID NO: 10032 - protein, 467 aa, Escherichia coli
MLLPVVMAGGSGTRLWPLSRTLYPKQFLSLTSRLTMLQETLRRLEGVEHRPALVICNEVHRFIVAEQMRNEHLANSGILLEPKGRNTAPAVALAALKAVSSGEDPILLVLAADHDIQDQERFISSILAAKEFAEEGKLVTFGIVPTKPETGYGYIKTGENLNEYGFKVSAFVEKPELDVAKKYLEDGGYLWNSGIFMFRASVFIDELNKFRPDILKICQQALKSSTQDLDFIRIDNDSFSCCPEESIDYAVMEKTTEAVVVPLNAHWSDVGSWSALWEISSKDKSGNAIRGDVLIHDSSDSYLYSQHRLIGVVGVKDLVVVETKDAILVAHKDKVQKVKNIVEQLKVNNRAEYQQHREIFRPWGSHDSIAEGSRFQVKHVVIHPGHKTAKQIHYHRTEHWIVVSGTAKVHYEDEIFLVSENESTYIPIGVPHFIENPGKIPLEIIEVRSGVYLDEDDVVRILNDDGY

SEQ ID NO: 10033 - protein, 461 aa, Escherichia coli
MLLPVVMAGGSGTRLWPLSRTLYPKQFLSLTSRLTMLQETLRRLEGVEHRPALVICNEVHRFIVAEQMRNVNLANSGILLEPVGRNTAPAVALAALKAISSGEDPILLVLAADHEIQDQKRFISSILAAKEFAEEGKLVTFGIVPTKPETGYGYIKTGENLNEYGFKVSAFVEKPELDVAKKYLEDGDYLWNSGIFMFRASVFIDELNKFRPDILKICQQALKSSTQDLDFIRIDNDSFSCCPEESIDYAVMEKTTEAVVVPLNAHWSDVGSWSALWEISRKDKSGNAIRGDVLIHDSSDSYLYSQHRLIGVVGVKDLVVVETKDAILVAHKDKVQQVKNIVEKLKVNNRTEYLQHREIFRPWGSHDSIAEGSRFEVKHVVIHPGHKTAKQIHYHRTEHWIVVSGTAKVHYEDEIFLVSENESTYIPIGVPHFIENPGKIPLEIIEVRSGVYLDEDDVVRI

SEQ ID NO: 10034 - protein, 479 aa, Escherichia coli
MNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 10035 - protein, 482 aa, Salmonella enterica subsp. enterica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALRRKEQEDPLLLVLAADHIIAKEEVFCNAVKKAVPIAENGNIVTFGIIPEYAETGYGYIERGVPFSVNANSTETDFYHVKKFVEKPDRLKAEKYISTGDYFWNSGIFMFKATVYLNELKKFRPDIYSVCEQVLSSSYRDLDFIRLPETLFKDCPAESIDFAVMEKTERCIVCPIDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGERYKVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 10036 - protein, 482 aa, Salmonella enterica subsp. indica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALKRKEQEDPLLLVLAADHIIAKEKVFCNAVKKAVPIAENGNIVTFGIIPEYAETGYGYIERGAPFSVNANSTETDFYHVKNFVEKPDRLKAEKYISTGDYFWNSGIFMFKATVYLNELKKFRPDIYSICEQVLSSSYRDLDFIRLPETLFKDCPAESIDFAVMEKTERCIVCPVDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGKRYKVKKIIVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 10037 - protein, 482 aa, Salmonella enterica subsp. salamae
MSDVPLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCSAIKKAVPIAENGNIVTFGIIPEYAETGYGYIERGAPISVNGNSTEIDFYHVKNFVEKPDRLTAEKYISTGNYFWNSGMFMFKATVYLNELKKFRPDIYNVCEQVVSSSYRDLDFIRIPETLFKDCPAESIDFAVMEKTEHYIVCPINIGWSDVGSWQSLWDISEKTDEGDVCKGDILTYNTKNNYIYSESALVAAVGVEDIVIVQTKDAILVSKKSDVQDVKKIVEMLKTQDRTEYIAHREVFRPWGKFDSIDQGERYRVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 10038 - protein, 474 aa, Salmonella enterica subsp. salamae
MNYIQPVILCGGNGTRLWPLSRELFPKQFLNINASESMLQRTLSRLEGLPVGAPVLICNEKHRFITAEQIRATNRKPESIILEPFGRNTAPAIALAALKNIEDAKDPLMLILAADHVFNDETSFRRAIMSACYYAESDKLVTFGIVPTKPETGYGYIKRGDSVNTCSSYLAFNVSAFVEKPDIEKAATYVSSQEYYWNSGMFLFKASKYIEELKKFRPDIIEACTKALALSHADLDFIRIDQQAFQTCPSDSIDYAVMEKTSDAIVVPMDAGWSDVGSWSSVWDVAVKNIENNVINGDVVALDTVNSYLHADGCLLTTIGINDLVIVCTKDAVLVAERNASQNVKNIVDTLKRNGRYEHQKHREVYRPWGKYDSIDSSERYQVKRITVKPGEGLSLQMHYHRAEHWIVVAGTARVTINDEVRLLGENESIYIPIGAKHCLENPGKIALELIEVRSGAYLEEDDIIRFADKYGRV

SEQ ID NO: 10039 - protein, 473 aa, Salmonella enterica subsp. indica
MIPVILAGGTGSRLWPLSRELFPKQFLKLSSELTMLQATFARLNDLNYKNSIVICNEAHRFIVAEQLREIGKLSNNIILEPHGRNTAPAITLAALAVKQRFPDKDPLILILAADHIIKDDRIFCNLIKKAAPLANKGKFVTFGIVPFKPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 10040 - protein, 478 aa, Salmonella enterica subsp. enterica
MAAETLIPVIMAGGTGSRLWPLSRELYPKQFLCLQNNLSMLQSTISRLDGIKHASPIVICNEKHRFIVADQLLQMNQLTNNIILEPVGRNTAPAVALAALVAKNNSSKEDPLLLILAADHVFTNENEFRITVSKAIPFADRGKLVTFGIVPSKAESGYGYILRGNKLQLEDDIIAFDVEQFVEKPSIETAQAYVASGDYYWNSGMFLFRAGRYLEELKKYRPDILIACEKSISDLNIDLNFVRINEDDFYPCPDVSIDYAVMEHTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFRDRYGRK

SEQ ID NO: 10041 - protein, 478 aa, Salmonella enterica subsp. enterica
MTNMRLCPVVMAGGIGSRLWPLSRELYPKQFLCLQAKTTMLQATINRLDGLRCQEPIVICNEQHRFIVAEQLREINKLAGNIILEPFGRNTAPAIALATIAMRNNSVDHDPLLLILAADHIIQNEEAFRDAVRGAMSYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 10042 - protein, 339 aa, Zea mays
MASAIKAASTSSRWSSSPAAVHSSPLSKRLPAAVAMPGRRRSVATVRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNSLELVLLTTPSTPADRMEEITRASRGFVYLATVNGVTGPRANVNTRVQSLIQEVKQVTDIPVAVGFGISKPEHVKQIAEWGADGVIIGSAMVRQLGEAASPKEGLKRLEKYARSMKNALPCQ

SEQ ID NO: 10043 - protein, 132 aa, Zea mays
MANGGAAAGKLTVAETFSNLREQGKSAFIPFITAGDPDLVTTSKALKILNSCGSDVIEVGVPYSDPLADGPVIQASATRALKKGTTLDSVIEMLKGVTPELSCPIVLFTYYNPILKRGVGNFMSTIKQAGIH

SEQ ID NO: 10044 - protein, 274 aa, Zea mays
MANGGAAAGKLTVAETFSNLREQGKSAFIPFITAGDPDLVTTSKALKILNSCGSDVIEVGVPYSDPLADGPVIQASATRALKKGTTLDSVIEMLKGVTPELSCPIVLFTYYNPILKRGVGNFMSTIKQAGIHGLVVPDLPLEETTLLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVKQLCEAATPEEGLERLEEYARSMKAAMP

SEQ ID NO: 10045 - protein, 1008 aa, Arabidopsis thaliana
MLLVLDLGISSLVLVVSLVLPLIGLFVRHKWRVAAQRREEIRRLLIHASEEAARAELEASVEFSSVAVSNVFHCPVCYCLATTRCSRCKAVRYCSGKCQIIHWRQGHKDECHPASIVYDSEDESDSDLRLGEENGQNTPEETLLVGPEPVTIPIGESLLSNRARSPEDGNGDIADNKDDLIDNEEAVSVAETSGSSFSGFSSSPRNDSGDEISRCESFSSSESERSESLLDAHVSVEPEDTCFSTIEDAPSKLLSPKFVHLVESVDNLANLPKLSVHKPEDDAGQNQSQSRSLHSLVTDRHPVSADPSLKSSDFWGTALGSAERVSDSCVKSKSGRPGNSSLHFSFGSGSSRDTSAAKVSEQRSSILKEAPRGTGYISDGVNLRERNAKRFDEAEIALPISSSTDALSPLDSSNLSHVTLPKSKSASSENGSMLAPLKVGEVQLLASKASNTKKCADLMKHSPLGAKSVRVLDHQKQNGAVVQHINSLHGRSGLKASVLKVVDQWTRPKSENEMAGRHGHKGLFPYEVFAKLYTYKIEFQPCGLINVGNSCFANVVFQCLMFTPPLTTYFLQQFHSRACTKKEQCFTCGFEKLVVKAKEEKSPLSPNGLLSQLQNIGIFLGNGKEEDAHEFLRFVVDTMQSVCIKASEYDMTKSSKLEDTTLIGLTFGGYLRSKIKCMKCQVKSELREKMMDLTVEIDGDISTLDDALRRFTRTEILDGENKYRCGSCKSYERAKKKLKITEPPNVLTIALKRFQAGKFGKLNKLIRFPETLDLAPYVSGGSEKSHDYKLYGVIVHLDVMNAAFSGHYVCYIRNQNKWYKADDSTVVTSDVERILTKGAYMLFYARCTPTPPRLAVCTKTEASNKKSRVPLPKANEKSTISRSVSTSSPELSSNTPGGGRSGNIQSFYSSFQRLQKILEEDSASDSSSLFDSNSDECSCSTDSTSMDDFADFIFGDHQGRAHGQSETPSPTSSSSSSSPPFTRRSPLSRSSPETYGTSRHQLPLGGER

SEQ ID NO: 10046 - protein, 402 aa, Arabidopsis thaliana
MLPVKDVVTTSVLSKPWRSLWKLVPTLKFDYENNQSEDETYSEIVCRLLLSNKAPFLESLHLGFRFGECRSVEVGMWIGIAYARHVRDLVLHVESVKGSFIFPTGLYNCETLESLTLRSWVLVDVPSPACLKSLRTLRLENVDYKYDDSVYNLLSGCPNLENLVVYRGNLLEVETFTIAVPSLQRLTIYDDNDGEYCTGYVINAPSLKYLKIDGFKALESCLIENAPELVEATIMNVSKIINEKLLETLTSVKRLSLALSPLELKFSCNNYSEWWNLLVLMLDSSPKLQVLKLIGKLSGENNHLASMNWDQPKNIPGCLLFNLETFMWKGCKRIGEDEKEVAKYILRNTNRLKRATFTREIYEENNSQDMFENLEMVEELESVVRASKSCKLAFETSLWSLS

SEQ ID NO: 10047 - protein, 498 aa, Arabidopsis thaliana
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSATPPRV

SEQ ID NO: 10048 - protein, 466 aa, Arabidopsis thaliana
MNSGDVFILSRSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 10049 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTRVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 10050 - protein, 259 aa, Tulipa gesneriana
MPISRIAIGSPQEATQAGALKAALAEFISTLIFVYAGQGSGIAFGKLSVDGVTTPAGLVAAAIAHAFALFVAVSVGANISGGHVNPAVTFGAFLGGNITLLRGVLYIIAQLLGSSVACLLLRFTTGLGTGHFGLVAGVSIWSGLVMEIVMTCGLVYTVYATAVDPKKGDIGTIAPIAIGFIVGANILVGGAFTGASMNPARSRSGRALVSWSWTSHWVYWVGPLIGGGIAGIVYDLFFINSTHEPAPKHRLLIGGWRRR

SEQ ID NO: 10051 - protein, 368 aa, Candida albicans
MATLKNKNNHLKACSTYTDNENHFLVDSRYEIVRVLGKGSYGVVCSAIDTKSSVSAMEHKIAIKKVTKIFNKDILLIRAIRELKFMMFFRGHKNLDVVYVKPYEGLYCFQELADLDLARVLYSNVQFSEFHIQSFMYQVLCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLGVEQILEPEFFKNLRNVHGEPSSKAIFDFSFEEKGKSIPQLKEILETEVRVFKEISKTGIE

SEQ ID NO: 10052 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 10053 - protein, 230 aa, Antirrhinum majus
MATINLSLLPKTLTPNSKTLAPLLSILSTSSLSFLPCTRPHPIKSRSAAYPTVRALTDGEYSSRRNNNNNNSGEERETIMLPGCDYNHWLIVMEFPKDPAPTREQMIDTYLNTLATVLGSMEEAKKNMYAFSTTTYTGFQCTVTEETSEKFKGLPGVLWVLPDSYIDVKNKDYGGDKYVNGEIIPCQYPTYQPKQSRSSKYKSKAYVRQRDGPPAEQRRPKQEATPESST

SEQ ID NO: 10054 - protein, 140 aa, Perilla frutescens
MAEQHQQHRPTHDTSRDLHDKGPSTSQVLAVATLFPVGGFLLGLAGLILTGTLFGLAVSTPLFLIFSPIIVPAVIAIALAVAGFLTSGVFGITALSSVSWIFNYFRRMRASWPEQFDQARRRVGDTASHMGQKAQDAVRT

SEQ ID NO: 10055 - protein, 468 aa, Douglasia nivalis
  misc_feature (309)..(309): Xaa can be any naturally occurring amino acid
KAGVGFKAGVKDYKLTYYTPDYKTKDTDILAAFRVTPQPGVPPEEAGAAVAAESSTGTWTTVWTDGLTNLDRYKGRCYHIEPVAGEENQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAXALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWENAPGAVANRVALEACVQARNEGRDLAREGNEVIREACKWSPELAAACEVWKEIKFEFEAMDTL

SEQ ID NO: 10056 - protein, 468 aa, Primula cortusoides
  misc_feature (23)..(23): Xaa can be any naturally occurring amino acid
  misc_feature (311)..(311): Xaa can be any naturally occurring amino acid
  misc_feature (405)..(405): Xaa can be any naturally occurring amino acid
EAGVGFQAGVKDYKLTYYTPDYXPADTDILAAFRVTPQPGVPPEEAGAPVAAESSTGTWTTVWTDGLTNLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSYYCRDNGLLLHIHRAMHAVIDRQKNHGIHFRVLAKRXRMSGGDHIHSGTVVGKLEGEREITLGFVDLLRDDYIEKDRSRGIYFTQDWVSLPGVLPVASGGIHVWHMPALTEIFGDDSVLQFGGGTLGHPWXNAPGAVANRVALEACVQARNEGRDLAREGNEIIREACKWSPELAAACEVWKEIKFEFEAMDTL

SEQ ID NO: 10057 - protein, 468 aa, Omphalogramma delavayi
  misc_feature (298)..(298): Xaa can be any naturally occurring amino acid
  misc_feature (405)..(405): Xaa can be any naturally occurring amino acid
KAGVGFKAGVKDYKLTYYTPDYDPADTDILAAFRVTPQPGVPPEEAKAAVAAESSTGTWTTVWTDGLTNLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQXNHGIHFRVLAKRLRMSGGDHIHSGTVVGKLEGEREITLGFVDLLRDDYIEKDRSRGIYFTQDWVSLPGVLPVASGGIHVWHMPALTEIFGDDSVLQFGGGTLGHPWXNAPGAVANRVALEACVQARNEGRDLAREGNEIIREACKWSPELAAACEVWKEIKFEFAALDTL

SEQ ID NO: 10058 - protein, 373 aa, Arthrobotrys dactyloides
MASPTPPNSTASPKPQAPPSQVQACRYKTGKTLGSGSYSVVRECVHIHTGRYYAAKIINQKLMAGREHMVRNEIAVLKKVSMGHQNILTLVDYFETMNNLYLVTDLALGGELFDRICRKGSYFESDAADLIRATLSAVAYLHDHGIVHRDLKPENLLFRTPEDNADLLIADFGLSRIMDEERFHVLTTTCGTPGYMAPEIFKKTGHGKPVDIWAIGVITYFLLCGYTPFDRDSNLEEMQAILKADYKFEPAQYWSDISENAKDFIRRCLTIDPKARPTAHAALEHPFICEDQPEREADLLPTVRKNFNARRTLHAAIDTIRAINKLREGGMMDGALSSAPENQKEKQPQNQPATGLWQGTAQAATAKGLWSKS

SEQ ID NO: 10059 - protein, 513 aa, Apium graveolens var. dulce
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 10060 - protein, 466 aa, Pternandra cogniauxii
RVGFKAGVKDYRLTYYTPDYIVKDTDITAAFRVTPQPGVPPEEAGAAVAAESSTGTWTAVWTDGLTSLDRYKGRCYNIEPVAGEENQYICYVAYPLDLFEEGSVTNMFTSIVGNVFGFKALRALRLEDLRIPTAYIKTFQGPPHGIQVERDKLDKYGRPLLGCTIKPKLGLSAKNYGRAVYECLRGGLDFTKDDENVNSQPFMRWRDRFLFCAEALYKAQTETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRMDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 10061 - protein, 466 aa, Pternandra hirtella
RVGFKAGVKDYRLTYYTPDYIVKDTDITAAFRVTPQPGVPPEEAGAAVAAESSTGTWTAVWTDGLTSLDRYKGRCYNIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRMDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 10062 - protein, 465 aa, Memecylon bakerianum
VGFKAGVKDYNLTYYTPDYETKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERGITLGFVDLLRFDFIEKDRSRGIYFTQDWVSLPGVIPVASGGIHVWHMPALTEIFGDDAVLQFGGGTLGHPWGNAPGAVANRVALEACVQARNEGRDLAREGNEIIREASKWSPELAAACEVWKEIKFEFEAMDTV

SEQ ID NO: 10063 - protein, 465 aa, Amphiblemma cymosum
VGFKAGVKDYRLTYYTPDYQVKPTDTLAAFRVTPQPGVPPEEAGAAVAAESSTGTWTTVWTDGLTSLDRYKGRCYNIESVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRIDYIEKDRSRGIYFDQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 10064 - protein, 495 aa, Pisum sativum
MALQVLTLPSWVTLFTTFAILLLFSRRLRRRQYNLPPGPKPWPIIGNFNLIGTLPHQSLHGLTQKYGPIMHLWFGSKRVVVGSTVEMAKAFLKTHDATLAGRPKFSAGKYTTYNYSDITWSQYGPYWRQARRMCLLELFSAKRLESYEYIRKQELHVFLHELFDSRNKTILLKDHLSSLSLNVISRMVLGRKYLEKVENSIISPDEFKNMLDELFLLNGILNIGDFIPWIHFLDFQGYVKRMKVLSKKFDGFMEHVLEEHIERRKGVKDYVAKDMVDVLLQLAEDPDLEVKLERHGVKAFTQDLIAGGTESSAVTVEWAISELIRKPEIFKKATEELDRVIGRERWVEEKDIANLPYVYAIAKETMRLHPVAPMLVPREAREDCNINGYDIPKGSLILVNTWTIARDSNVWDNPNEFMPERFLGKDIDVKGHDYELLPFGAGRRMCPGYPLGIKVIQSSLANLLHGFNWRLSDDVKKEDLNMEEIFGLSTPKKIH

SEQ ID NO: 10065 - protein, 356 aa, Gaeumannomyces graminis
MSRAANPPSNSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDVGSRLDLLEKLLAFNPVKRITVEEALKHPYLEPYHDPDDEPTAPPIPEEFFDFDKHKDNLSKEQLKQFIYQEIMR

SEQ ID NO: 10066 - protein, 2018 aa, Geobacillus stearothermophilus
MVKGRWRKYVAYFSIFLLFAQLFSFSAIVRANESVQSPVVNGNDVTFRYVGTGEEQSVLLAGSFNDWQTDGEKKIELTKESDHIWSVTKTLPDGTYMYKFVVDGNWMTDPLNNNKADDGYGGKNSVVVVGQPAQQQERVVTLVGNLQNELGHEKEWDPAATATVMKHEGNGLYTFTGVLPAGTYEYKIAINGSWDENYGAGGRNGGNISFTLEKETEVTFYYHDSTHAIADSTWYTPIPKEKQPRLVGTILPAIGYEKEVDGWTPETSSAFLVDNNFDFIYTFTARVPKGNYEFKVTLGNSWDENYPQDNAKLNVLEETTITFFFNAKTKELYTDYSPTGSDGNVQKDRLKHNTWDSLYRQPFGAVKAGTEVTLRLAAKKGDVTKANVYVKNTTTGTAKLYAMSKVGVIGDDEYWEATFTPEEKGLYGYKFIAMDGAAKAEYGEDTQEGQWGRAADKNVELFQLTVYDPNYKTPDWMKQAVVYQIFPDRFFNGNPNNDKVKKYARGNEPIEHREWSELPDNPRMKATPGYDGDGIWSNDFFGGDIAGIEQKLDYLQSLGVNTIYLNPIAHAPSNHKYDAHDYKAIDPMFGTPEEFESFVQAVASRGMHLILDGVFNHVSDDSIYFDRYGKYPTVGAYEYWSAVYDLMNDKGLSEEEARVQVEQKFKDEGQQFSPYGFHLWFNIENEKVNGAYKYQAWWGFDSLPEFKSISGTKVPYASELNNEQLANYIFYEQDSVAKSWITRGASGWRLDVANEVDTEFWREFRKELLQGDYDRGPTLKSGQQPLILGEIWDDASKYFLGDQYDSVMNYRFRGAVLDFLRNGKAEEIDARLTAIREDYPEEAFYALMNLIGSHDTARAVFLLGNGTDSYERAELDPNYNEQLGKKRLKLAAILQMGYPGAPTIYYGDEAGVTGSKDPDDRRTYPWGSEDTELIAHYQKVGTVRTEHQDVLAKGTIETVYAKGDVYVFARQYGKDVALIAINRGNSAQTVQLDVSSIIPNGTSFVDELHGEYEVTVSNGKVQLNIPAFDGRMLFGKVTVNMPNEVTNVQATAGVGQVTLTWEGDAPTYRIYQSTLKGAGYTLVKETNEKEAVIGGLKNGTAYYFAVTAVDENGNESAKVETNRVVPHYPLDEQHIVHVDIVSDDVLDLAKAIVVEAKVRIDDVTKHGLADGLQAVLQVKRPNHEKWENVQAAYERQDGEDNVFRASFIPLASGTYTYRYGFTTNLGDSWVYTEEKTFTLAANEADQQAPAKGIQLVQPDVESGQVNLSWSFVERDDHDAYMVVIERDGQVIYTTTTISTSFTDYDVENGKTYTYVVKLYDRAGNVVESNAVEVTPNIVMVQVTFKVRAPSYTPLDTRITIPNSLNGWNTGAWEMTRGGAVTSDWEFTTELQEGETIIYKYVKGASWDQEGLADHTRDDQTDDDVSYYGYGAIGTDLKITVQNQGNNKMIIQDYILRWIDMPVVIEEVKKDGDRVTIKGNAIKGGVLTINKERVTIHDDMSFTYTFTPNANQKEVAIHIEPSEESKANIFKNDGGAIAKNTKNYVLNIETKQLREGVLTEQPDSGTTPGSGTTPGSGTTPGSGTTPGSGTTPGSGTTPGSGTTPGSGTTPGSGTTPEKGAVVVEPKVEVKERDGKVVEKVAAVSSNDIATIVNELSNEKKQVVISTGSLVKDVATKVDVPASLFVQAANKQSDATIVSASEQAVYKLPAKEVKQAVDQVAKQLGTTVDQVSISIEMKVKDAPQLPVKTLSDAVQFHVVAKANGKEQAIDRFTQYVEREIALKQPVQPNRAVVVRVNDDGSLTPVPTTFVDQKAVAKSLTNSTYVVVEGTTTFADIVQHWAKPYIDSLAAKQLVRGVTETAYRPNEPMTRAQFAVLLVRALALPSETYDGRFADVKGTEWFNQHGELAAAVKYGVIQGKTPSTFAPNEPITRAQAAVMIERALNLSFVNFDKAAKDQTKKLADFRDANQLPAWSKQAIEAIYQAGIVQGHPDGTFAPAGRMTRAEMAKVLAEFLAKAKLM

SEQ ID NO: 10067 - protein, 498 aa, Calystegia sepium
MAPIPGVMPMGNYVPVYVMLPLGVVNSDNVFPDQDKVENELKQLKEAGCDGIMVDVWWGIIEAKGPKNYDWSAYKELFQLVRKCGLKIQAIMSFHQCGGNVGDAVFIPIPKWILQIGNNNPDIFYTNKAGNRNQEYLSLGVDNQSLFDGRTALEMYRDFMESFRDNMTNFLRAGDIVDIEVGCGAAGELRYPSYPETQGWVYPGIGEFQCYDKYMVADWKEANKQAGHANWEMPKNAGTYNDTPEKTEFFRLNGTYDSEFGKFFLTWYSNKLIIHGDQILEQANKVFVGFRANIAAKVSGIHWWYNDVSHAAELTAGFYNISGRDGYRPIARMLARHHTTLNFTCLEMRDSEQPAEAKSAPQELVQQVLSSGWKEFIDVAGENALPRFDATAYDQMLLNVRPNGVNLNGPPKLKMSGLTYLRLSDDLLLKDNFELFKKFVKKMHADLDASPNAISPPVLERSNSAIAIDELLEATKVSRAFPWYDVTDMPVDGSNPFD

SEQ ID NO: 10068 - protein, 211 aa, Emericella nidulans
VPFHVNTIKNASKSDEGEYAYLRINFLSPGQGVGRKDDQPFEDLSAHFLRNLTLRSKDNDRFAQVAQDITELRKNALRREQEKKEMEDVVEQDKLVEIRNRRPVKLPDVYLRPPLDGKRVPGEVEIHQNGLRYVSPFRNEHVDVLFSNVKHLFFQPCAHELIVLIHVHLKTPIMIGKRKTRDIQFYREATEMQFDETGNRRRKHRYGDEDE

SEQ ID NO: 10069 - protein, 173 aa, Neurospora crassa
VPFHINTIKNASKSDEGEWSFLRINFLSPGQGVGRKDEQPFEDASAHFVRSLTFKSTDGDRYADIANQISNLKRDAVKKEQEKKDMEDVVEQDKLVEIRNRRPAVLDNVFIRPAMEGKRVPGKVEIHQNGIRYQSPLSTTQRVDILFSNVRHLFFQPCQHELIVIIHIHLKDP

SEQ ID NO: 10070 - protein, 248 aa, Nicotiana glauca
MPGIAFGRIDDSFSVGSLKAYLAEFISTLLFVFAGVGSAIAYNKLTANAALDPAGLVAVAVCHGFALFVAVAVGANISGGHVNPAVTFGLALGGQITLLTGLFYIIAQLLGSIVACLLLKVVTGGLAVPTHNVAAGVGALEGVVMEIIITFALVYTVYATAADPKKGSLGTIAPIAIGFIVGANILAAGPFSGGSMNPARSFGPAVASGDFTNNWIYWAGPLVGGGLAGLTYSNVFMQHEHAPLSSDF

SEQ ID NO: 10071 - protein, 284 aa, Nicotiana glauca
MAKNVGSEGSFTTKDYQDPPPAPLIDPVELTQWSFYRALIAEFIATLLFLYITVLTVIGYKSQSATTTDPCAGVGILGIAWAFGGMIFVLVYCTAGISGGHINPAVTFGLFLARKVSLIRAVMYMVAQCLGAICGVGLVKALQSAYYHRYDGGVNMLSDGYSHGVGLSAEIIGTFVLVYTVFSATDPKRNARDSHIPVLAPLPIGFAVFMVHLATIPITGTGINPARSLGAAVIFNQHKAWKDHWIFWVGPFIGAAIAAFYHQFILRAGAAKALGSFRSSTSQV

SEQ ID NO: 10072 - protein, 156 aa, Nicotiana glauca
FILVYCTAGISGGHINPAVTFGLFLARKVSLIRAVLYMVAQCLGAICGVGFVKAFQSAYYVRYGGGANVMAPGHTKGVGLAAEIIGTFVLVYTVFSATDPKRNARDSHVPVLAPLPIGFAVFMVHLATIPITGTGINPARSFGAAVIYNHDKAWDE

SEQ ID NO: 10073 - protein, 229 aa, Synechococcus sp. WH 7803
MVTTPDAFGIGGFSIHWSAAMPPTTASVQSQCPYCGVGCGLDLLPPGEAGKAVKRDAEGNPMWSARGHREHPSSHGQVCIKGATVGETLGQGRLSQPLYRATLTDPFEAISWNSAFDLLTERIQSTLASKGADAIAMYGSGQFHTEDYYIAQKLLKGALGTNNFDANSRLCMSSAVAGYTRSLGSDGPPCCYEDLDHCSVVILIGTNTAECHPVLFQRLLKRKKRDPSL

SEQ ID NO: 10074 - protein, 468 aa, Ardisiandra wettsteinii
KAGTGFKAGVKDYKLTYYTPEYKTKDTDILAAFRVTPQPGVPPEEAGAAVAAESSTGTWTTVWTDGLTSLDRYKGRCYHIEPVLGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVVSGGIHVWHMPALTEIFGDDSVLQFGGGTLGHPWENAAGAVANRVALEACVQARNEGRDLAREGNEIIREACKWSPELAAACEVWKEIKFBFEAMDTL

SEQ ID NO: 10075 - protein, 337 aa, Thermococcus litoralis
MVRLRLEDIEFKQADFRLDIPSLEAKPGEFLTLLGPSGCGKTTTLRIIAGFEKPDKGKIYFNDTVMNDVPPYERNIGIVFQDYALFPHMTVYDNISFGLKLRKLSKEEIKRRVSWALELVGLKGFEDRYPEQLSGGQQQRVALARALVIEPQLLLLDEPLSNLDAKIRERLRGEIKRIQKELGITTIYVTHDQEEAMAISDRIAVMSVGKIEQIGNPLDLYYNPKNEFVARFLGLSNILEVNAEEGKAYVGNLCFEVKTEGRVKIFFRPESVYIEEGDMGEIVDYELLPGRIRLKIDVEGKIIIAERFLDEIPFSIEKIPKKVGIKVKSFSILSSSP

SEQ ID NO: 10076 - protein, 139 aa, Pisum sativum
NTDITSITSNGGRVKCMQVWPPIGKKKFETLSYLPPLTRDQLLKEVEYLLRKPWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 10077 - protein, 124 aa, Candida albicans
MSEELPQIEIVQEGDNTTFAKPGDTVTIHYDGKLTNGKEFDSSRKRGKPFTCTVGVGQVIKGWDISLTNNYGKGGANLPKISKGTKAILTIGPNLAYGPRGIPPIIGPNETLVFEVELLGVNGQ

SEQ ID NO: 10078 - protein, 124 aa, Streptomyces anulatus
MSIEKPEVDFPGGEPPADLAIKDIWEGDGPVAQAGQTVSVHYVGVAFSTGEEFDASWNRGTPLQFQLGAGQVISGWDQGVQGMKVGGRRELIIPAHLAYGDRGAGGGKIAPGETLIFVCDLVAV

SEQ ID NO: 10079 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLELTSTKQSFYDTVKSLQEKGHLAPPPPPPSASQESVENGIKIGS

SEQ ID NO: 10080 - protein, 200 aa, Schizosaccharomyces pombe
MTTELRRKLVIVGDGACGKTCLLIVFSKGTFPEVYVPTVFENYVADVEVDGRHIELALWDTAGQEDYDRLRPLSYPDSHVVLICFSVDAPESLDNVQEKWISEVLHFCSNLPILLVGCKVDLRNDPKTIEELSKTSQKPITFEEGQVVAQKIGAYKYLECSAKLNEGVNEVFETAARASMLKFKPASVPKTKKKKHCILL

SEQ ID NO: 10081 - protein, 371 aa, Medicago sativa
MSVESAENNIRGVPTHGGRYLQYNIYGNLFEVSRKYVPPIRSVGRGAYGIVCAAVNAETREEVAIKKIGNAFDNRIDAKRTLREIKLLRHMDHENVMSIKDIIRPPQKENFNHVYIVSELMDTDLHQIIRSNQPMTDDHCRYFVYQLLRGLKYVHSANVLHRDLKPSNLLLNANCDLKIGDFGLARTTSETDFMTEYVVTRWYRAPELLLNCSDYTAAIDIWSVGCILGEIVTRQPLFPGRDYVHQLRLVTELIGSPDDASLGFLRSENARRYVRQLPQYPKQNFSARFPNMSPGAVDLLEKMLIFDPSKRIKVDEALCHPYMAPLHDINEEPVCARPFSFDFEEPMFTEEDIKELIWKESVRFNPDPPIN

SEQ ID NO: 10082 - protein, 151 aa, Actinobacillus actinomycetemcomitans
RKAKVAAGEAGGITQHIGAYHVETDDGKMITFLDTPGHAAFTSMRARGAKATDIVVLVVAADDGVMPQTIEAIQHAKAAGVPIVVAVNKIDKPEANPEHVEQELLQYDVIAEKFGGDVQFVYVSAKKGTGVDELLEAILLQSEVLELTAVK

SEQ ID NO: 10083 - protein, 389 aa, Mycoplasma genitalium G-37
MAAGKRDYYEVLGISKNASSQDIKRAFRKLAMQYHPDRHKAENETTQKQNEEKFKEVNEAYEVLSDEEKRKLYDQFGHEGLNASGFHEAGFNPFDIFNSVFGEGFSFGMDGDSPFDFIFNRSKKRQQQIVVPYNLDIALVIEINFFEMTNGCNKTIKYERKVSCHSCNGFGAEGGESGLDLCKDCNGNGFVIKNQRSIFGTIQSQVLCSTCNGQGKQIKVKCKTCRSNKYTVTNQIKEINIPAGMYSGEALVDESGGNEFKGHYGKLIIQVNVLASKIFKRSDNNVIANVLVDPMVAIVGGVIELPTLEGIKEFNIRPGTKSGEQIVIPNGGIKFSKSFKRKAGDLIIIISYARPCEYTNLELKKLREFIKPNQEVKQYLNTLKNEYKT

SEQ ID NO: 10084 - protein, 362 aa, Mycoplasma genitalium G-37
MDSYLFLAKNLNLKNYGPVQKKQYGHLVLKVVQKNPKINENNWKKFLDEMVTTTRVHHSNLVKSFDVVNPFLKIVRGNKTIALNQIVMIAMEYVDGPSLRQLLNRKGYFSVSEVVYYFTKIVKAIDYLHSFKHQIIHRDLKPENILFTSDLTDIKLLDFGIASTVVKVAEKTEVLTDENSLFGTVSYMIPDVLESTVNKAGKKVRKPPNAQYDIYSLGIILFEMLVGRVPFNKSINPNKERETIQKARNFDLPLMQATRSDIPNSLENIAFRCTAVKRENNKWLYSSTKELLEDLANWENEQAMIKPANERVLEGQVEIREMMLEKPLAWYFKTWALSIFTIVFIGLIIAAIVLLLIFNARF

SEQ ID NO: 10085 - protein, 433 aa, Mycoplasma genitalium G-37
MFMSDKLLTIDLSHVYGFDKEIIFKKYQKKVDQIHQDFLAHKLADGHMTGWYDQPDQNHQFLLKTINQIDKKFKSLKVTDIVYVGIGGSFTGIKTVLDFLKPKQRTGLKIHFVPDLSAFQAASVIKEIKNKSWALITTSKSGRTLEPALNFRIFRNLLNKRYGNKHYQRVVVITDEKKGLLTKMASNHGYQKLVIDSNIGGRFSTLSPAGLLLAKLFGHDPKAILKGTLQAKKDLQTTSLENNSAYLYAVVRHWLYTTKKFKIEVCIAYHSLYEYLLLQHRQLFGESEGKNDKSLFPTFSIFTVDLHSMGQLYQEGEKVFFETVIDVKNPLVNINLPPSDFDNDDELDFLLDKSLNEISDVAIDSVIKAHYQANVSIIKLTLKEQSAFMFGYFYFWLSVATVMSGSLLGHNVFNQPGVEVYKKLMFEKLRSGH

SEQ ID NO: 10086 - protein, 214 aa, Mycoplasma genitalium G-37
MVAQFNKFIILGPPGAGKGTVCKLLSKTTKLVHIASGDLFREAIKNQSVIGRKIAAIISQGGYVDDATTNQLVYEYITTNPLPNGFILDGYPRTENQLDFLNIKLTIDMVFELVVSDLNKLITRIDNRVICNNCNSVYNLLFQKPLVENSCDQCSAKLVKRSDDNKAVVKARMELYQQTIQPIHTYFFNKQLLVQIDCFLPLEEQLKTIKQFIR

SEQ ID NO: 10087 - protein, 508 aa, Mycoplasma genitalium G-37
MIDHLKRTKIIATCGPALTKSLVSLKMLDDNEYAAIKKVAYANIEAIIKSGVSVIRLNFSHGTHEEQQVRIKIVRDVAKAMNIPVSIMLDTNGPEIRIVETKKEGLKITKDSEVIINTMSKMIASDNQFAVSDASGKYNMVNDVNIGQKILVDDGKLTLVVTRVDKQHNQVICVAKNDHTVFTKKRLNLPNAQYSIPFLSEKDLKDIDFGLSQGIDYIAASFVNTVADIKQLRDYLKLKNASGVKIIAKIESNHALNNIDKIIKASDGIMVARGDLGLEIPYYQVPYWQRYMIKACRFFNKRSITATQMLDSLEKNIQPTRAEVTDVYFAVDRGNDATMLSGETASGLYPLNAVAVMQKIDKQSETFFDYQYNVNYYLKNSTANKSRFWHNVVLPLTKKTVPKRKLVNSAFKYDFIVYPTNNINRIYALSNARLAAAVIILTNNKRVYTGHGVDYGIFCYLIDKNPNQLTKAELIELAWKAINHYQAYGDLEKLKQCLAVYNETIINL

SEQ ID NO: 10088 - protein, 457 aa, Mycoplasma genitalium G-37
MDYDLIILGAGPAGYIAAEYAGKHKLKTLVIEKQYFGGVCLNVGCIPTKTLLKRAKIIDYLVHAKDYGITINGQAKLDWKQLLKQKQEVVDKLVAGVKTIIKGAKVESIEGEATVIDKNKVQVNNTTYTTNNIIVATGSRPRYLTLPGFEKAQQAGFIIDSTQALALEGVPKKFVVVGGGVIGVEFAFLFASLGSEVTIIQGVDRILEVCDSDVSELISKTLKNKGVQIITNAHVVRAENNQLFYTVNGVEQSVIGDKILVSIGRIANTECLDQLDLKRDHNNKIVLNEKLQTSTTNIYLIGDVNTQMMLAHYAYQQGRYAVDQILNQNQVKPAEKNKCPACIYTNPEVAFVGYSEMELQKEKIDYVKSSLPFIYSGKAIADHETNGFVKMMFNPKTGAILGGCIIASTASDIIAELALVMENNLTVFDIANSISPHPTMNEMVTDVCKKAIFDYFS

SEQ ID NO: 10089 - protein, 416 aa, Mycoplasma genitalium G-37
MLSSNMLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 10090 - protein, 458 aa, Mycoplasma genitalium G-37 [sequence omitted]

SEQ ID NO: 10091 - protein, 507 aa, Mycoplasma genitalium G-37
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVISFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 10092 - protein, 244 aa, Mycoplasma genitalium G-37
MRTRYLIGNWKTNKNLKDAVSFVEQFQQNKLNYNAKIGIAPVYVHLTEIKKIISDSLLLFAQDANFIESGSYTGTVSFTQLQDIGVNNSIIGHSERRKYYNETSAVINQKLFACLKASMQVVLCIGEALGQEISFLKTDLTNCLDTIDKSLIKNLVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 10093 - protein, 175 aa, Mycoplasma genitalium G-37
MGIKSIVINEQQIEEGCQKAVNWCNAKFNNKKVIVLGILKGCIPFLGKVISKFSFDLQLDFMAVASYHGSHVQKQPPKIVLDMSHDPKDKDILLIEDIVDSGRSIKLVIDLLKTRHAKSITLISLIEKIKPKAFDINIDFSCFKVKDNFLVGFGLDYDGFYRNLPYVGVFEPDNP

SEQ ID NO: 10094 - protein, 151 aa, Actinobacillus pleuropneumoniae
RKAKVAAGEAGGITQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVK

SEQ ID NO: 10095 - protein, 252 aa, Helianthus annuus
QYGRETRHTGDYENPIHSTGGQYEQEVLQTDEYGNPVRRTGQTDEYGNPVRRTDEYGNPVHSTTGGTMGDYGSTGLGQGTGTGGTGTGGYGTTGHHGLGTGIGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10096 - protein, 252 aa, Helianthus annuus
QYGRETRHTGDYENPIHSTGGQYEQEVLQTDEYGNPVRRTGQTDEYGNPVRRTDEYGNPVHSTTGGTMGDYGSTGLGQGTGTGGTGTGGYGTTGHHGLGTGISHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10097 - protein, 252 aa, Helianthus annuus
QYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTSGGAGYGETHEKKGMMEKIKEKLPGHH

SEQ ID NO: 10098 - protein, 252 aa, Helianthus annuus
QYGRETRHTSDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGAGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10099 - protein, 259 aa, Helianthus annuus
ANYGGDKQYGRETRHTGDYENPIHSTGGQYEREVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGAGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10100 - protein, 257 aa, Helianthus annuus
ANYGGDKQYGRETRHTGDYGNPIHSTGGQYEQEVLQTDEYGNPVRRTGQTDEYGNPVRRTDEYGNPVHSTTGGTMGDYGSTGLGQGTGGIGIGGYGTTGHHGFGTGVGHTTGGTGTDYTSGGRSTGQTGYQGLGTESEFGGKTGTFQNQPSATPVGGVGLSSGTGAGVGGTGTGTAILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10101 - protein, 257 aa, Helianthus annuus
ANYGGDKQYGRETRHTGDYENPIHSTGGQYEQEVLQTDEYGNPVRRTGQTDEYGNPVRRTDEYGNPVHSTTGGTMGDYGSTGLGQGTGGIGTGGYGTTGHHGLGTGIGHTTGGTGTDYTSGGRSTGQTGYQGLGTESEFGGKTGTFQNQPSATPVGGVGLSSGAGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 10102 - protein, 253 aa, Helianthus annuus
ANYGGDKQYGRETRHTGDYENPIHSTGGQYEQEVLQTDEYGNPVRRTGQTDEYGNPVRRTDEYGNPVHSTTGGTMGDYGSTGLGQGTGGIGIGGYGTIGHHGLGTGVGHTTGGTGTDYTSGGRSTGQTGYQGLGTESGFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTAGGAAHEKKGMMEKIKEKLPGHH

SEQ ID NO: 10103 - protein, 151 aa, Haemophilus aegyptius
RKAKVAAGEAGGITQHIGAYYVEMDDGKMITFLDTPGHAAFTSMRARGAKATDIVVLVVAADDGVMPQTIEAIQHAKAAGAPLVVAVNKIDKPEANLDRVEQELLQHDVISEKFGGDVQFVPVSAKKGTGVDDLLDAILLQSEVLELTAVK

SEQ ID NO: 10104 - protein, 151 aa, Haemophilus sp. CCUG 31340
RKAKVVAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDDLLDAILLQSEVLELTAVK

SEQ ID NO: 10105 - protein, 151 aa, Haemophilus sp. HK855
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDDLLDSILLQSEVLELTAVK

SEQ ID NO: 10106 - protein, 151 aa, Haemophilus sp. HK856
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDDLLDAILLQSEVLELTAVK

SEQ ID NO: 10107 - protein, 151 aa, Haemophilus haemolyticus
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDELLDAILLQSEVLELTTVK

SEQ ID NO: 10108 - protein, 151 aa, Haemophilus parainfluenzae
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGTGIDDLLDAILLQSEVLELTAVK

SEQ ID NO: 10109 - protein, 151 aa, Haemophilus sp. HK22
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPERVEQELLQYEVISEKFGGEVQFVPVSAKKGTGIDELLDAILLQSEVLELTAVK

SEQ ID NO: 10110 - protein, 151 aa, Haemophilus parainfluenzae
RKAKVAAGEAGGITQHIGAYHVEMDDGKLITFLDTPGHAAFTSMRARGAKVTDIVVLVVAADDGVMPQTIEAIQHAKAAGAPLVVAVNKIDKPEANPDRVEQELLQHEVISEKFGGDVQFVPVSAKKGIGIDDLLDAILLQSEVLELTAVK

SEQ ID NO: 10111 - protein, 151 aa, Haemophilus sp. HK847
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGIGIDDLLDAILLQSEVLELTAVK

SEQ ID NO: 10112 - protein, 151 aa, Haemophilus paraphrohaemolyticus
RKAKVAAGEAGGITQHIGAYHVETNDGKMITFLDTPGHAAFTSMRARGAKATDIVVLVVAADDGVMPQTIEAIQHAKAAGAPLVVAVNKIDKPEANPDRVEQELLQYEVISEKFGGDVQFVPVSAKKGTGIDELLDAIVLQSEVLELTAVK

SEQ ID NO: 10113 - protein, 151 aa, Haemophilus paraphrohaemolyticus
RKAKVAAGEAGGITQHIGAYHVETNDGKMITFLDTPGHAAFTSMRARGAKATDIVVLVVAADDGVMPQTIEAIQHAKAAGAPLVVAVNKIDKPEANPDRVEQELLQYEVISEKFGGDVQFVPVSAKKGTGIDELLDAIVLQSEVLEFTAVK

SEQ ID NO: 10114 - protein, 151 aa, Haemophilus segnis
RKAKVAASEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGMGIDDLLDAILLQSEVLELTAVK

SEQ ID NO: 10115 - protein, 151 aa, Haemophilus segnis
RKAKVAAGEAGGITQHIGAYHVETDDGKMITFLDTPGHAAFTSMRARGAKATDIVVLVVAADDGVMPQTIEAIQHAKAAGVPIVVAVNKIDKPEANPERVEQELLQYDVIAEKFGGDVQFVYVSAKKGTGVDELLEAILLQSEVLELTAVK

SEQ ID NO: 10116 - protein, 151 aa, Haemophilus segnis
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGMGIDDLLDAILLQSEVLELTAVK

SEQ ID NO: 10117 - protein, 151 aa, Haemophilus sp. CCUG 18944
RKAKVAAGEAGGITQHIGAYHVETNDGKMITFLDTPGHAAFTSMRARGAKATDIVVLVVAADDGVMPQTIEAIQHAKAANAPLVVAVNKIDKPEANPDRVEQELLQHEVISEKFGGDVQFVPVSAKKGLGIDDLLEAILLQSEVLELTAVK

SEQ ID NO: 10118 - protein, 151 aa, Haemophilus paraphrophilus
RKAKVAPGEAGGITQHIGAYHVETEDGKMITFLDTPGHAAFTSMRARGAKATDIVVLVVAADDGVMPQTIEAIQHAKAAGVPIVVAVNKIDKPEANPEHVEQELLQYDVIAEKFGGDVQFVYVSAKKGTGVDELLEAILLQSEVLELTAVK

SEQ ID NO: 10119 - protein, 151 aa, Haemophilus paraphrophilus
RKAKVASGEAGGITQHIGAYHVETEDGKMITFLDTPGHAAFTSMRARGAKATDIVVLVVAADDGVMPQTIEAIQHAKAAGVPIVVAVNKIDKPEANPEHVEQELLQYDVIAEKFGGDVQFVYVSAKKGTGVDELLEAILLQSEVLELTAVK

SEQ ID NO: 10120 - protein, 151 aa, Haemophilus ducreyi
RKAKVAAGEAGGITQHIGAYHVETEDGKMITFLDTPGHAAFTSMRARGAKATDIVVLVVAADDGVMPQTIEAIQHAKAAGAPLVVAVNKIDKPEADPSRVEQELLQYEVVSEKFGGDVQFVAVSAKKGMGIDELLEAIILQSEVLELTAVK

SEQ ID NO: 10121 - protein, 151 aa, Haemophilus influenzae
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANLDRVEQELLQHDVISEKFGGDVQFVPVSAKKGTGVDDLLDAILLQSEVLELTAVK

SEQ ID NO: 10122 - protein, 151 aa, Haemophilus haemolyticus
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDELLDAILLQSEVLELTAVK

SEQ ID NO: 10123 - protein, 151 aa, Haemophilus parainfluenzae
RKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGTGVDDLLDAILLQSEVLELTAVK

SEQ ID NO: 10124 - protein, 207 aa, Hypocrea jecorina
MPLCGGSKTVQRKLVLLGDGASGKTSLLNVFTRGYFPTVYEPTVFENYVHDIFVDNVHIELSLWDTAGQEEFDRLRSLSYDDTDLIVLCYSVDSKDSLENVESKWVGEIADNCPGVKLVLVALKCDLRQQEDDEPEDQAAADGNAQREKPPTISYDEGLEVAKRIGASRYLECSAMKNRGVNEAFTEAARVALSVKKEREDNKCTIM

SEQ ID NO: 10125 - protein, 473 aa, Sulfolobus acidocaldarius
MPGLPKNEHEALEFLKSNNIKWVDLQFTDLLGKLQHITIPSNEFDESSFKVGFGKLDGSSIKGFTSIYESDMVLLPIPQTMTLIPWMQGVARVLTKVFWGGGKGRFERDPRGIAEEAEKYQSEQGYVSYFGPELEFFVFDKVEVDASLPQSGTGYKIHSREAPWSKNGGYVIRYKEGYYPASPVVQLMDIRLEIISTLVDYFGTIEAAHHEVATAGQGDIDFRFSTLADTADKVQVLKYVTKNIASKRGMIATFMPKPFFGDNGSGMHTHFSLWTKDGKNLMYDPNDEYAELSQIGRYIIGPLLEHGRALSAIVVAGTTNSYRRLVPGYEAPVYLVWSKSNRSAAIRIPAYYKGMEKAKRLEYRPPDPSSNPYLVFSAILMAGLDGIRRKLDPGDPVDENIYHMSEEKKRSLKIRELPGSLDEALNELESDNEFLKPVFNSSILQAYLDLKKEEAKMMQLYPHPMEIYQYLDS

SEQ ID NO: 10126 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 10127 - protein, 1847 aa, Streptomyces natalensis
MVPVHTDDYAIQPPADTAHGGGGFTLPAVFEAAVESAPDAVALVDGTVPGPGRMWRADVDALARGLQESGIAPGDVVAVRLPNCGRFPTLHLAVAAVGAVLLPIHQGTPLPEVDALLTRAEPALLVLSAAGSDGLATARSLLESVPSLRGVLLAGASGDGESGSVGGGESGSGRRSLDGLLAGWAGSGPRPVDVTPDMPLVLVPSSGTVSARPKLCVHSHDGLLSNTAAVTAEAADAFDGPVLTACPMTHLFGLQSLHAALFAACTQVLLTGWDVDRFLEQAREHGPRVVFAVPAQLRDVVTRLARTGEPAGFTPYQVRTAGAAVAPALAVRVRAVLDCELVVVWGMSEIGTGTRTRAHHPDGCVGEPVSGVDVRVVDEHGQECAADERGELQYRGPGLFRGYFREPELTRSALTDDGWLRTGDLATVDADGVVVLHGRAAELINTGGRKFSAGEVEGLLSGFTDLGPLAVVGAPDDRLGEYPCLVVTDHADGTIGLSEVTAFLRRLGLADHKIPLELVTVRELPFSPAGKLDRGALKRLLANLAEVSVPARLGAVPPYTAEEALDLVRDCVGRVLRYGGAAVPFPPDKDFFSPDKDFRQLGLDSIGAVRLRNLLREETGLPLPATLAFDSPTPRAVARVLAEQEEPSQDEPRENPADGADPVAIVGMACRLPGGADSPDALWELLADGTDAMSPFPTDRGWDLDRLFDEDADRPGTSYAREGGFLHDAGDFDAGFFGLSDQEATATDPQQRLLLEAAWETFERAGIDPQSLRGSRTGVFTGAMDRGYGTSASAAPSAWESMLITGTAGSAVSGRIAYTYGLEGPALTVDTASSSSLVALHLACRSLRSGETDLALAGGVTVMATPAPFAHFSRLRALSPDSRSMAYADAANGSAWSEGAGLLLLERLSDARRNGHRVLALVRGSAVNQDGASNGLTAPSGPAQQRVIRQALADAGLTPQDVDAVEGHGTGTPLGDPIEAQALLATYGQQRPVERPLWLGSVKSNFGHTQAAAGVVGVIKTVLALRHGVLPQTLHVDAPSAKVDWSAGSVRLLTEARPWPRESGRTRRAGVSSFGLTGTNAHVILEEAPGEAAAGARAEVPEEARCASSPARLPEPPGDAAAPWVLSARSRAALRAQALRLADQVAADPGLRAQDVAHALATSRTLHRHRAVVSGSDRAQMLAAAKRFGLGERTAGVTPDDSAPGLLAFVFSGQGSQRSGMGRAAAEAFPVFGRALGEVCAALDPLLTRPLTSVMWAAPGSEEAARLDDTTYTQPALFAVQVALYRLFESWGVVPDQLVGHSVGEISAAHVAGVLGLRDACTLVAARSRLMGALPPGGAMVAVRITEPEVTPWLAELTDEVSIAAVNGPHSLVLAGAEAPLVALTDRLAAAGHKTRRLMVSTAPHSPLMDPMLEEFRAVVRTLSYAAPAVPLVSTVTGRPLTGEEARDPDHWVRHVRQSVRFKDAIGRLRDERVTGFLELGAEPALTPMIDECLESADGQPGTALVPSLRAGVPERDALLTAVARVHAQGVPVDWDAVLPGAEASVTVRGLPAADRQWFRFVPDQGAPLTLADRSLHLEGAAHLRDVGGCRTADGRWVKMGVLYRTNNLHALTDADLAKLQRLGIRTDFDLRMPGERAKAPNRVPTGARYIVADAFDAHLRDGLSLSERDLERLREARLSGLDEAEQHALVLALVLAETSAVLGGQETPGEEPHGEEGHRTFKEMGINSLNAVELRNRLIAATDLRLPATLVYDYPTPKAVVRLVRERLARPASPARDVASVVAELESLLTAGAEVSEETAARLKAVTAVSTGTTGSGSGTGAGSGGALDLVSASDEELFRLMDAES

SEQ ID NO: 10128 - protein, 151 aa, Pasteurella avium
RKAKVAAGEAGGITQHIGAYHVETDDGKMITFLDTPGHAAFTSMRARGAKATDIVVLVVAADDGVMPQTIEAIQHAKAAGVPIVVAVNKIDKPEANPDRVEQELLQHEVIAEKFGGDTQFVYVSAKKGTGVDELLDAILLQSEVLELSAVK

SEQ ID NO: 10129 - protein, 150 aa, Pasteurella multocida
RKAKVASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVK

SEQ ID NO: 10130 - protein, 242 aa, Petrotoga miotherma
MGDPQGFLKYERKNPEERPPKMRINDWEELYIEMEKDELRIQAARCMNCGTPFCHSGILINNMVSGCPLNNLIPEWNDLAYRNLWREAYERLIETNSFPEFTGRVCPAPCEKACVNNLVKDPVSIKSIEYYIIEEAFKNGWVEEDKPSYSTGKKVAVVGSGPAGLSCAWELNRYGHEVTVFEKNEYPGGLLTYGIPNMKLDKKIAKRRIELMGKSGIQFKTNVNVGKDYPVQKLKEEFDAVT

SEQ ID NO: 10131 - protein, 203 aa, Oryza sativa (indica cultivar-group)
MAANPGNKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTIMALAGNKADMVEARQVPAEEAKTYAQENGLFFMETSAKTAINVNDVFHEIAKRLLQGQQAQDTPAGMVLNQRPAERMVSSSSCCS

SEQ ID NO: 10132 - protein, 151 aa, Citrobacter freundii
KVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGMA

SEQ ID NO: 10133 - protein, 144 aa, Citrobacter freundii
GGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGMA

SEQ ID NO: 10134 - protein, 152 aa, Citrobacter freundii
TKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGMA

SEQ ID NO: 10135 - protein, 156 aa, Citrobacter freundii
LLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRK

SEQ ID NO: 10136 - protein, 155 aa, Citrobacter freundii
DYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKG

SEQ ID NO: 10137 - protein, 148 aa, Citrobacter freundii
SGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGMA

SEQ ID NO: 10138 - protein, 156 aa, Citrobacter freundii
DYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGM

SEQ ID NO: 10139 - protein, 153 aa, Citrobacter freundii
RSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGM

SEQ ID NO: 10140 - protein, 153 aa, Citrobacter freundii
IRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKG

SEQ ID NO: 10141 - protein, 149 aa, Citrobacter freundii
TKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRK

SEQ ID NO: 10142 - protein, 148 aa, Citrobacter freundii
KVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRK

SEQ ID NO: 10143 - protein, 154 aa, Citrobacter freundii
YIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKG

SEQ ID NO: 10144 - protein, 151 aa, Citrobacter freundii
STKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKG

SEQ ID NO: 10145 - protein, 150 aa, Citrobacter freundii
KVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGM

SEQ ID NO: 10146 - protein, 446 aa, Arabidopsis thaliana
MFSMDYKAPRKYSHGRNFGVARQQDFAADIVTRRPYAPYDNGMKKGPNKLSRNLVWTSKEYKSPEGNRPRQNAANGSAKPQVIGTGHRVSNQPRKNAVYGPRSSSLSDTRGCGPRLNGSPKKSVCNFWKDGNCKKGEKCQFLHSWSCFPGLAMVAALEGHKNDIKGIALPQGSDKLFSVSGDGTLLIWDCNSGQCVRSINLQAEAGSLISEGPWVFLGLPNAVKAFNVQNSKDVHLEGVVGQVHAMTAANGMLFAGTSSGSILVWKATDSESDPFKYLTSLEGHHSGEVTCFVVGGEVLYSGSVDKTIKVWDLNTLQCRMTLKQHIGTVTSLLCWDKCLISSSLDGTIKLWACSENESLKVVQTRKQELSVHTLCGMHDAEAKPIMFCSYQNGAVGIFDLPSFEERGKMFSTQTICTLTIGPGGLLFSGDKSGNLRVWSLASGTKV

SEQ ID NO: 10147 - protein, 104 aa, Zinnia elegans
LQNSQDVTIHSTKLACGDDCISIQTGCSGVNIQNVDCGPGHGISIGSLGKDNTRACVSNITVRDTKIHDTMTGVRIKTWQGGSGAVQGVTFSNIQVSKVETAII

SEQ ID NO: 10148 - protein, 270 aa, Atriplex lentiformis
MALVPHYLFSFVFLLKISLLINSCLCFNPKLFNVSKYYQDNSHWSLGGATWYGSPNGAGSDGGACGYTNTVDKPPYSGMVTAAGSSLYSFGDGCGVCYEVKCTGNQACSGKPVTVTITDECPGCPSDKPHFDLSGTAFGAMAKSGQAEQLRNAGVLDIQYKKVKCNYPGVTVEVRVDPGSNPYYFASTIEYTDGLGIESVKIKQQSGEWVSLQQSWGAVWEFHAPNGLHPPLTLQLVEAQSGDTLTLSNVIPKGWNPGQTYRSHVNFNNN

SEQ ID NO: 10149 - protein, 1052 aa, Candida albicans
MSEVNIDAGLFYKRLSIFQKQLTANNIPQALIIVGARSDDNTYKKSTVLQNWLLGYEFIHTAIYITDKKCIFITSEGKSKHLKHLTNQKPDLVELWIRTKDVEHNKQLFIKLLETMTKLDSKYGKILKDKYDGKFIDEWNQILNDNNNNTTNDHALSAVDLAVTVSQALAVKDSEEFNNTKIASNASVVMMDTFVNDMMIIVDDEKKITNSQLTDQIEDKIENNKWYLKTKLGKNLLQSIKDFDPEYLEYCYSPIIQSGGDYDLKPSAVSTDKPLIGEGVILSSIGLRYKSYCSNIARTFLIDPTSEMETNYDFLLQLQKYIVDNLLKDGVPASKVYQDTIDYIKKERPDLVNHFTKNCGWLLGMEFRDSTFILNAKTTDRKLTTGQIISLTIGFNNLSNDKNDKNDNKTNHQKNKQTYALLLTDTIKITDDSSILLTNYSKDRAAISFSFNDDNETQKENNNNNNKRPGLSQTSNTTGLKLESTENTAILKSKLRHENTNADDANSEKLRQEIQIKLHEKRLQEGLARFSKADATDADDFKPIFKKYESYVRESQIPNSVNDLKIHIDYKNQTIILPISGRPVPFHINSYKSGSQNEEGDFTYLRLNFNSPGAGGNVTKKQELPYEDSPDNSFLRSITIRSRDRQRMVDVYKAIQDLKKDSVKREQEKKQMADVITQANLIELKGSRVKKLNNVFIRPTPDTKKIGGVLQIHENGLRYQSQPQSQSQSNFKNDQRVDVLFSNIKHLFFQPCKDELIVLIHCHLKNPIMIGKRKTFDVQFYREASDMAFDETGGRKRKYRYGDEDELQQEQEERRRKALLDKEFKGFAELIADSSHGMVDLDIPFRELGFQGVPFRSSVLCVPTRDCLVQLIDPPYLVVTLEEIEIAHLERVQFGLKNFDLVFVFKDFNKPVVHINTIPVELLEDVKSWLTDVDIPISEGQMNLNWVQIMKTVLADPYQFFIDGGWAFLTGQGESDEEEESDEESDFRVSDEDPQDEDEESDDYASEEESDDYSGSDDDGSGGGDDDDSESGEDWDALERKAAKADRNSGFD

SEQ ID NO: 10150 - protein, 463 aa, Streptomyces venezuelae
MQFHDSMISLVGNTPLVKLNNVTAGIQATVLAKVEYFNPGGSVKDRIAVRMIEAAEQSGELKPGGTIVEPTSGNTGVGLAIVAQQKGYKCIFVCPDKVSLDKINVLRAYGAEVVVCPTAVDPEHPDSYYNVSDRLVRETPGAWKPDQYSNPNNPRSHYETTGPELWEQTDGKITHFVAGVGTGGTISGTGNYLKEASGGSVKIIGADPEGSVYSGGSGRPYLVEGVGEDFWPTAYDRNVTDRIVAVSDKDSFQMTRRLAKEEGLLVGGSCGMAVVAALEVARELGPDDVVVVLLPDSGRGYMSKIFSDEWMAGHGFLEDTSSATVADVLRHKEGGTMPSLVHMHPDETVGQAIEVLREYGVSQMPIVKPGAGHPDVMAAEVVGSVVERDVLDALFTQRASLEDSLESHMSAPLPQVGSGEPVAALMSVLGDAADAAIVLVEGKPTGVVSRQDLLAFLANGGAK

SEQ ID NO: 10151 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 10152 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 10153 - protein, 171 aa, Escherichia coli
MDYFTLFGLPARYQLDTQALSLRFQDLQRQYHPDKFASGSQAEQLAAVQQSATINQAWQTLRHPLMRAEYLLSLHGFDLASEQHTVRDTAFLMEQLELREELDEIEQAKDEARLESFIKRVKKMFDTRHQLMVEQLDNETWDAAADTCRKLRFLDKLRSSAEQLEEKLLDF

SEQ ID NO: 10154 - protein, 375 aa, Pinus banksiana
QVIKCKAAVAWGAGEPLKIEEVEVDPPQSMEVRIKVHYTALCHSDLIFWEAKGQTPLFPRIFGHEAAGIIESVGEGVTDLKEGDTVLPVFTGECKECRHCKSEESNMCDLLRVDIETGVMKSDGKSRFSINGKPIYHFAGTSTFSEYTVVHSGCVAKINPKAPLNKVCILSCGVSTGMGAALNVAKPKQGSTVAIFGLGTVGLAAAEGSRMAGASRIIGIDLNSDKFERAKLFGVTESLNPLDYEKSIQQVIAEKTDGGVDYSIECTGNVKAMIQAFESCHIGGGVTVLVGFPPSDAVFATNPLNFLCERTLKGTFFGNYKPLSHLPGLVELYLNKKLELEKFITHEVSFADINKAFDYMIKGESLRCVINVIGN

SEQ ID NO: 10155 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNVCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLERFITHEVSFADINKAFDYMIKGESLRCVTNVIGN

SEQ ID NO: 10156 - protein, 375 aa, Pinus banksiana
RVIKCKAAVAWAAGEPLKIEEVEVAPPQAMEVRVKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYLDKKLELEKFITHEVSFADINKAFDYMIKGESLRCVINVIGN

SEQ ID NO: 10157 - protein, 375 aa, Pinus banksiana
QAIKCKAAVAWAAGEPLKIEEVEVASPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDCSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 10158 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYDKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 10159 - protein, 374 aa, Pinus banksiana
QVITCKAAVAWGPGQPLKIEEVEVAPPQAMEVRIKVYYTALCRTDLVFWEAKGQTPLFPRIFGHEAAGIVESVGEGVTDLKPGDSVLPVFTGECKECRHCKSEESNMCALLRINTDRGVMISDGKSRFSVNGKPIYHFLGTSTFSEYTVVHVGCVAKINPKAPLSKVCILSCGVSTGMGATLNVGKPKKGSTVAIFGLGSVGLGAAEGARIAGASRIIGVDLNSDRYEQAKLFGVTEFINPQDYEKPVQEVIAEKTDGGVDCSIECTGNVKAMIQAFESCHDGWGVSVLVGVPHSDAVFATHPINFLNERTLKGTFFGNYKPRSDLPGLVEMYLDKKLELDKFITHEVSFADINKSFDYMIKGESLRTVIKVSD

SEQ ID NO: 10160 - protein, 375 aa, Pinus banksiana
QVIKCKAAVAWAAGEPLKIEEVEVAPPQAMEVRIKIHYTALCHTDVYFWEAKGQTPLFPRILGHEAAGVVESVGEGVTDLKEGDTVLPVFTGECGECRHCKSEESNMCDLLRINTERGVMISDGKTRFSKDGKPIYHFLGTSTFSEYTVAHAGCVAKINPEAPLDKVCVLSCGASTGMGAALNVAKPKKGSTVAVFGLGAVGLGAAEGARIAGASRIIGIDLISERFEKAKLFGVTEFINPLDHAKPVQEVIAEKTDGGVDYSIECTGNVKAMIQAFESCHDGWGVAVLVGVPHSDAVFQTSPLNFLTERTLKGTFYGNYKPRSDLPGLVEMYLAKKIELEKFITHEVSFADINKAFDYMLKGESLRCIINLIGN

SEQ ID NO: 10161 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLEKFITHEVSFADINKAFDYMIKGESLRCVTNVIGN

SEQ ID NO: 10162 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 10163 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYEKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 10164 - protein, 369 aa, Cryphonectria parasitica
MFSTLLLAALLPLIQAAPAPAVTPAAHLEDRASKSCTFTDAAAVSKSKASCATITLNNIAVPSGTTLDLTKLNSGTKVIFAGTTSFGYKEWEGPLISVSGTDIEVTGASGHVIDGNGAAWWDGEGSNGGKTKPKMFYAHSLKQSTIHNLKVKNTPVQFMSINSATDLNVIDVTMDNSAGASKGHNTDAFDVGSSENIYISGAVINNQDDCLAINSGTNITFTSGSCTGGHGLSIGSVGGRSDNTVKTVSITNSKIINSQNGVRIKTVYDATGSVSDVTYSGITLSGITNYGIVIEQDYENGSPTGTPTTGVPITGLTVSKVTGSVASSATDVYILCGKGSCSGWKWSGNSVTGGKKSSSCKNIPSGASC

SEQ ID NO: 10165 - protein, 475 aa, Pinus edulis
MSPKTETKASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREASKWSPELAAACEIWKEIKFEFDVIDRL

SEQ ID NO: 10166 - protein, 475 aa, Afrocarpus falcatus
MSPKTETKASAGFKAGVKDYRLTYYTPEYPTKDTDILAAFRVTPQPGVPPEEAGAAVAAESSTGTWTTVWTDGLTSLDRYKGRCYDIEPVPGEENQYIVYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFCFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREVTLGFVDLLRDDFIEKDRSRGIYFTQDWVSMPGVIPVASGGIHVWHMPALTEIFGDDSVLQFGGGTLGHPWGNAPGAVANRVALEACVEARNEGRDLAREGNEVIREASKWSPELAAACEVWKEIIFEFETIDTL

SEQ ID NO: 10167 - protein, 475 aa, Pinus wallichiana
MSPKTETKASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHVHAGTVVGKLEGERDVTLGFVDLLRDDFIEKDRSRGVYFTQDWVSMPGVLPVASGGIHVWHMPALTEIFGDDSVLQFGGGTLGHPWGNAPGAAANRVALEACVQARNEGRDLAREGNEVIREACKWSPELAAACEIWKEIKFEFDVIDRL

SEQ ID NO: 10168 - protein, 475 aa, Pinus longaeva
MSPKTETKASVGFKAGVKDYRLTYYTPEYQTKDTDILAAFRVTPQPGVPAEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 10169 - protein, 475 aa, Pseudotsuga menziesii
MSPKTETKASVGFKAGVKDYRLTYYTPEYQTKDTDILAAFRVTPQPGVPPEEAGAAVAAESSTGTWTTVWTDGLTSLDRYKGRCYDIEAVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDYL

SEQ ID NO: 10170 - protein, 475 aa, Picea pungens
MSPKTETKASVGFKAGVKDYRLTYYTPEYQTKDTDILAAFRVTPQPGVPPEEAGAAVAAESSTGTWTTVWTDGLTSLDRYKGRCYDIEPVAGEETQFIAFVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHGGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAVDTI

SEQ ID NO: 10171 - protein, 475 aa, Pinus pinea
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 10172 - protein, 248 aa, Helianthus annuus
MPGIAFGSFDDSFSLSSIKSYVAEFISTLLFVFAGVGSAIAFAKLTADADLDPAGLVAIAVCHGLALFVAVSIAANISGGHVNPAVTFGLAVGGQITILTGIFYWIAQCIGSIAACYLLSFVTGGLAVPTHAVAAGVGAIQGVVMEIIITFALVYNVYATAVDPKKGDLGTIAPLAIGLIVGANILAAGPFSGGSMNPARSFGPAVAAGDFSGHWIYWVGPLVGGGLAGAIYSNVFISNEHAPLSSEF

SEQ ID NO: 10173 - protein, 248 aa, Helianthus annuus
MPGIAFGSFDDSFSSSSIKAYIAEFISTLLFVFAGVGSAIAYAKLTADAALDPSGLVAIAVCHGLALFVAVSIAANISGGHVNPAVTFGLAVGGQITILTGLFYWIAQLLGSVAACFLLSFVTGGLAVPTHGVAAGVGVLQGVVFEIIITFALVYTVYATACDPKKGALGTISPIAIGFIVGANILAAGPFSGGSMNPARSFGPTVAAFDFSGHWFYWVGPLIGGGLAGAIYPNVFISNEHIPLTNDY

SEQ ID NO: 10174 - protein, 248 aa, Helianthus annuus
MPGIAFGSFDDSFSSSSIKAYIAEFISTLLFVFAGVGSAIAYAKLTADAALDPPGLVAVAVCHGFALFVAVCIAANICGGHVNPAVTLGLAVGGQITFLTGLFYWIAQLLGSTVACFLLSFVTGGLAVPTHGVAEGVGTIQGVVFEIIITFAMVYTVYATACDPKKGALGTIAPIAIGFIVGANILAAGPFSGGSMNPARSFGPAVASFDFSGHWIYWVGPLVGGGLAGLIYPNVFISNEHIPLTNEY

SEQ ID NO: 10175 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 10176 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 10177 - protein, 40 aa, Lycopersicon esculentum
VGEKQKKRFVIPISFLIQPLFLDLLSQAEEEFGFDHPMGG

SEQ ID NO: 10178 - protein, 461 aa, Schizosaccharomyces pombe
MSIPHINKLSQDGRVRFSNWAKTFSAISLGLRCPKTEEQLREILVDANSNGKKIRVVGAGHSPSDIVCTSGYLLSLDKMNKVVSFDPDSLSITVQAGIRFYQVQEILQNLGYSLPIVGSISETSVSGIMSTCTHGSSLQHQVLPHYIKSMRIMLADGSIVTCSRELQKDMFAAAQVSLGALGVIVDITISVVPAFDLVATEDVTTVTDLFQDWKNNLIWESAEFVRVHVFPYANRAVVWRANKVEPNTVPHTPKPSLFRLKLDSFVYQCLLFVGKCVNRVTPYLERFWFKCHYGSKLGTALQVAGPGFDVLQMFCYFSQHVSEWGIPLESAPDALEKLINYTVDDAGKIGAYTHWPIEVRVCAPTPEDECWLSTDCKVPTCYIEAIMYRPFSTSINYKPYFKALEDIANQYNGKPHWAKEYSLTKEQLLERYPNLSKWLSLRKLLDPKGVFWNDYLQRHLG

SEQ ID NO: 10179 - protein, 181 aa, Antirrhinum majus
MAAKISSDPLVIGRVIGDVVDHFTSTVKMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 10180 - protein, 181 aa, Antirrhinum majus
MAAKISSDPLVIGRVIGDVVDHFTSTVQMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 10181 - protein, 151 aa, Triticum aestivum
MDASKLKKVAGKKFGGPRKKSVTRSIKAGLQFPVGRIGRYLKKGRYAQRVGSGAPVYLAAVLEYLAAEVLELAGNAAKDNKKSRIVPRHLLLAVRNDQELGRLLAGVTIAHGGVIPNINPVLLPKKAAEKAEKAGTKAKSPKKATKSPKKA

SEQ ID NO: 10182 - protein, 150 aa, Pisum sativum
MDASTKTKKGAGGRKGGGPRKKSVTRSVRAGLQFPVGRVGRFLKKGRYAQRVGTGAPVYLAAVLEYLAAEVLELAGNAARDNKKNRISPRHLLLAVRNDEELGKLLAGVTIAYGGVLPNINPVLLPKRKENAAASTPKSPSKAKKSPKKA

SEQ ID NO: 10183 - protein, 172 aa, Vibrio cholerae
MIDGDGYRLNVGIVICNNHGQVFWAKRYGQHSWQFPQGGIDDGESPEQAMFRELYEEVGLTKKDVKVIATSRHWLRYKLPKRLVRWDSQPVCIGQKQKWFLLRLECDESKINMQRGSSPEFDGWRWVSYWYPVRQVVSFKRDVYRRAMKEFASLAMPFKERKVKGKRNTHRG

SEQ ID NO: 10184 - protein, 448 aa, Helicobacter pylori
MAKKTSLFECQHCGFTSPKWLGKCVQCNAWESFIELNQAQKEVLNTLKKPIPQAQKSVSIAAIEHEEVIKFSSTQSELDIVLGGGIAKGGLYLVGGSPGVGKSTLLLKVASGLAKNQQKVLYVSGEESLSQIKMRAIRLDCIEKELYLLNEINWPVIKANIESENYFACVIDSIQTLYSPEISSAPGSISQVREITFELMRLAKTRDIAIFIIGHITKEGSIAGPRVLEHMVDSVLYFEGDPSRELRILRSFKNRFGPTSEIGLFEMKEQGLVSAKEASSLFFSKEEPMEGSAITITLEGSRALILEIQALVSECSFGSPKRLANGFDTNRLNMLIALLEKKLEIPLNRHDVFINVSGGIKISEPACDLAVIASILSSFKNRKIDNKTAFLGEVSLNGRILEAPNLNARLKEMENYGFLKAILPKKPSQKTSIKCYEANAVGKIVEWM

SEQ ID NO: 10185 - protein, 507 aa, Nepenthes alata
MPSLFVFIILLPLVFSDSNDGLLRIGLKKKIFDQNNRIAARLETEEGEARRSSLRKYYLHGNLGNPEETDIVALKNYMDAQYFGEIGIGTPPQKFTVIFDTGSSNLWVPSSKCYFSVPCYFHAKYKSSISSSYKKNGKSADIHYGTGAISGFFSEDNVQVGDLAVKAQEFIEASREPSVTFLVAKFDGILGLGFQEISVGNATPVWYNMVNQGLVKEPVFSFWLNRKVGEEEGGEIVFGGVDPNHFKGTHSYVPVTHKGYWQFDMGDVLIDGKATEYCEGGCSAIADSGTSLLAGPTSVVTMINHAIGATGVVSEECKAVVSQYGQTIMDLLLAEVSPEKICSQIGLCTFDGTRGVSIGIKSVVDKENNGKSSGILRDALCPACEMAVVWMKSQLEQNQTQNLILNYVNDLCDQLPSPMGESAVDCARISSMATVSSTIGGKVFDLRPEQYILRVGEGPAAQCISGFTAMDIPPPGGPLWILGDILMGRYHTVFDYGNLRVGFAEAA

SEQ ID NO: 10186 - protein, 505 aa, Nepenthes alata
MGHRNLWVIFCFCALISCFFSTSADGLVRIGLKRQFSDSNSIRAVRIARKAGMNQGLKRFQYSFGDSDTDIVYLKNYLDAQYYGEIGIGSPPQKFSVIFDTGSSNLWVPSSKCYFSVACYFHSKYKSSKSSTYTKIGKSCEIDYGSGSISGFFSQDIVEVGNLAVKNQVFIEASREKSLTFALAKFDGILGLGFQEISVGDVVPVWYNMVEQGLVSEKVFSFWFNRDPKAKIGGEIVFGGIDEKHFVGEHIYVPITRKGYWQFEMGNFLIGNYSTGFCRGGCDAIVDSGTSLLAGPMHVVTEVNHAIGAEGIASMECKEVVYQYGDMIWDLLVSGVQPDKICSQLALCFNDAQFLSIGIKTVIERENRKNSSVADDFLCTACEMAVVWIQNQLRREVTKEKVLNYINELCDSLPSPMGESVIDCDSIPYMPNVTFTIGEKPFKLTPEQYVLKAGEGDAMVCLSGFIALDVPPPSGPLWILGDVFMGVYHTVFDFGNLKLGFAESA

SEQ ID NO: 10187 - protein, 358 aa, Nepenthes alata
MGHRNLWVIFCFCALISCFFSTSADGLVRIGLKRQFSDSNSIRAVRIARKAGMNQGLKRFQYSFGDSDTDIVYLKNYLDAQYYGEIGIGSPPQKFSVIFDTGSSNLWVPSSKCYFSVACYFHSKYKSSKSSTYTKIGKSCEIDYGSGSISGFFSQDIVEVGNLAVKNQVFIEASREKSLTFALAKFDGILGLGFQEISVGDVVPVWYNMVEQGLVSEKVFSFWFNRDPKAKIGGEIVFGGIDEKHFVGEHIYVPITRKGYWQFEMGNFLIGNYSTGFCRGGCDAIVDSGTSLLAGPMHVVTEVNHAIGAEGIASMECKEVVYQYGDMIWDLLVSGVCPPLSSLLPLSWCILSFKGLEL

SEQ ID NO: 10188 - protein, 510 aa, Callistephus chinensis
MSILSLLVYFCISLLVIIALVNMFITRHTNRLPPGPAPWPVVGNLPHLGAIPHHTLAALATKYGPLVYLRLGFVHVVVASSPSVAAQFLKVHDLKFASRPPNSGAKHIAYNYQDMVFAPYGPQWTMFRKICKDHLFSSKALDDFRHVRQEEVAILARGLAGAGRSKVNLGQQLNMCTANTLARMMLDKRVFGNESGGDDPKANEFKEMATELMFLAGQFNIGDYIPVLDWLDLQGIVKKMKKLHTRFDKFLDVILDEHKVIASGHIDMLSTLISLKDDTSVDGRKPSDIEIKALLLELFVAGTDTSSNTVEWAIAELIRQPHLLKRAQEEMDSVVGQNRLVTEMDLSQLTFLQAIVKEAFRLHPSTPLSLPRIASESCEVDGYYIPKGSTLLVNIWAIGRHPEVWTDPLEFRPTRFLPGGEKPGIVVKVNDFEVLPFGAGRRICAGMSLALRTVQLLMGTLVQAFDWELANGIKPEKLNMDEAFGLSVQRAEPLVVHPRPRLPPHVYKSG

SEQ ID NO: 10189 - protein, 511 aa, Lycianthes rantonnei
MVLLLISELCASAIIFIIVHIIISKLIATGWGRRQRLPPGPMGWPVIGALPLLGTMPHVALAKMAKKYGPIMYLKVGTCGMVVASTPNAAKAFLKTLDINFSNRPPNAGATHLAYDAQDMVFAHYGPRWKLLRKLSNLHMLGGKALEDWANVRANELGHMLKSMFDASRVGGRVVVADMLTFAMANMIGQVILSKRVFVEKGAEVNKFKDMVVELMTVAGYFNIGDFIPQLAWMDLQGIEKGMKCLHKKFDDLLTKMFDEHKATTNERKGKPDFLDVVMANRDNSEGERLSTNNIKALLLNLFTAGTDTSSSAIEWALAEMMKNPQILKKVQQEMDQIIGKNRRLIESDIPNLPYLRAVCKETFRKHPSTPLNLPRISNEPCMVDGYYIPKNIRLSVNIWAIGRDPDVWENPLEFNPERFLSGKNVKIDPRGNDFELIPFGAGRRICAGTRMGIVMVEYILGTLVHSFDWKFSNDVKEINMEESFGLALQKAVPLEAMVTPRLPFDVYYTN

SEQ ID NO: 10190 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 10191 - protein, 511 aa, Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 10192 - protein, 319 aa, Citrus sinensis
MENFPVISLENINGAERAAILEKINEACEKWGFFELVNHGIEPEFMDTVERLTKAHYRKCMEQRFKELVASRALEGIQTEVNDMDWESTFYVRHLPQSTINEVPDLDEEYRKVMKEFALKLEKLAEELLDLLCENLGIEKGYLKKVFHGANGPTFGTKVSNYPPCPKPDLIKGLRAHTDAGGIILLFQDDKVSGLQLLKDGQWIDVPPLRHSIVVNLGDQIEVITNGKYKSVEHRVVSQTDGEGRMSLASFYNPGSDAVIYPAPALLEKEAEKKQVYPKFVFEDYMKLYVPLKFQAKEPRFEAMKAVETNVNLGPIATA

SEQ ID NO: 10193 - protein, 1070 aa, Myxococcus xanthus
MSKKRVHEIAKELKSHGIELDNKEVVTELSSLGYDVKSHSSSLDDDQATAAVQKILDKRKPKQATPPVTAKGFVVRRKVGPPAGATADSGAEASQAAEPAYEPPSAPEPATFAAEEPVQAPPPVEAPRAPVEAPSAPEPQRVEAPVAAATEPTAPAAVTSTPPAQVAEATKAPAAAEVASPPPAAEAPQAPVEAPRAAVPAPAAAQPRPSVQESTTLPQPPPRSPVPPAVRTPSSTSSSATVVSRGPAPGYQQRGGPGGGRPGGPGGPGGRPGGPGGPGGRPGGPGGPGGRPGGPGGPGGRPGGPGGRPSYQGPGSYQGAGRPGQGPVRPTSAPGTGVQASASASPIPQGPTIMVGGVPHAQVSPTGTARPTATQAVVISRPLIQVRRVTPTAGQAKQYPMAPGRTGIPERREYKVVPDHLGRGRELVDVSKNKERGQRKRTSGDTQSVSKQELTDMVWGRVTIPIRGKKRKPTKKGAKTQITQMAEEKKVIKLQEGISVSDLGQRMGVRSAELIKKLMGLGKMATANQLVDADTAEMIAGDYGWKIDRVGFEVEDYLPEVETRPEDERPRPPVVAIMGHVDHGKTSLLDAIRKASVAQGEAGGITQHIGAYSITTARGDVTFLDTPGHEAFTSMRARGADVTDIVVLVVASDDGVMPQTVEAIKHAKAAEVPIVVAINKMDLPTANLDRVKKDLATHELVPEEWGGDTIMVPVSAKTKENLELLLENLALQAEVLELASNPLRPSVGAIIEGQAGPRPWPVATVLVQEGTLKLGDAVVTGSHYGRVRAMTNSRGEQVKEVKPGYCAEVVGLSGVPGAGDAINVVADEKAAKQIAEHRNMKERQTELSKVSRESLEQLFAKTRRRWSQGAARRHQGGRAGLGRGRQAGRPEALHPQGQGGGGPLRCGRHHRGRRDAGGGLQGRRAGLQRQPGVGRRRAKAQEVVLKSYSIIYELIDGVRTEMEGLLEPIRTERKLGRAEVRNTFNVPRLGTIAGAAVLDGVMKRGAIVRLMRENKQLFSGKMASLRRFKDDVKEVAQGFECGIGIESFNDLKPGDIIEAYEIVETSQSLT

SEQ ID NO: 10194 - protein, 195 aa, Zea diploperennis
APLDKVCVLSCGISTGLGASINVAKPPKGSTVAVFGLGAVGLAAAEGARIAGASRIIGVDLSPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 10195 - protein, 195 aa, Zea perennis
APLDKVCILSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 10196 - protein, 195 aa, Zea perennis
APLDKVCVLSCGISTGLDASINVAKPPKGSTVAVFGLGAVGLAAAEGARIAGASRIIGVDLNPSRFEEAMKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 10197 - protein, 195 aa, Zea perennis
APLDKVCVLSCGISTGLGASINVAKPPKGSTVAVFGLGAVGLAAAEGARIAGASRIIGVDLNPSRFEEARKFGCTEFVNPKEHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 10198 - protein, 195 aa, Zea perennis
APLDKVCILSCGISTGLGASINVAKPPKGSTVAVFGLGAVGLAAAEGARIAGASRIIGVDLNPSRFEEARKFGCTEFVNPKDHIKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 10199 - protein, 349 aa, Torenia hybrida
MSMEVVVPKAQPITVCVTGASGFIGSWLVMKLLNRGYTVHATVRDPENMKKVKHLLELPRADDASLRLFKADMNVEGSFDEAVGSCECVFHMATPMDFESDDPENEVIKPTVDGMLSIIRSCAKAQTVKRLIFTNSAGTLNVEEHQKPVYDESNWSDLDFIYSTKMTGWMYFVSKVLAEKAAIKACKENNIDFISIIPPVVVGPFIIDNWPPSLITALSPITGNEAHYSIIKQGQFVHVDDLCEAHIFLSEHPKTEERYICSSHDATIYDIANMIREKWPEYDVPTEFEGIDKDIPVVRFSSKKLMGMGFTFKYTLEDMFREAIETCRDKGLLPYSSTRDHIHGEHKIE

SEQ ID NO: 10200 - protein, 511 aa, Torenia hybrida
MTVATTLVVVLSRELLLYVLVVYILVSKSLSTIIVVSRKRLPPGPTGFPVVGALPLLGSMPHVALAKMAKKYGPVMYLKTGTLGMVVASTPSSARAFLKTLDSNFSNRPANAGATHLAYGAQDMVFAPYGPRWRLLRRLSNLHMLGGKALDGWANVRASELGHMLEAMNRASREGEVVVVPEMLVYAMANMIGQVILSRRVFVTKGEEVNEFKDMVVELMTSAGYFNIGDFVPILAWMDLQGIERGMKALHKKFDKLITRMLEQHEASAHKPDFLDAIIAASLDDYSSEEERLSTSNIKALLLNLFTAGTDTSSSTIEWALSEMLKKGKILKRAQEEMDRVVGRERRLVESDIEKLGYLKAICKETFRKHPSTPLNLPRISSEACVVNGHYIPKGTRLSVNIWAIGRDPEVWEDPLEFNPDRFLHSKMDPRGNDFELMPFGAGRRICAGTRMGIVLVEYILATLVHSFDWKAADQDNNIMNMEEAFGIALQKATPLKALVTPRLPLHCYLP

SEQ ID NO: 10201 - protein, 168 aa, Thanatephorus cucumeris
TLTALMGVSGAGKTTLLDCLATRTTMGVITGQMLVDGKPRDDSFQRKTGYAQQQDLHLSTSTVREALTFSAVLRQPAHVSRKEKVEYVEEVIKLLEMTEYADAVVGVPGEGLNVEQRKRLTIGVELAAKPALLLFLDEPTSGLDSQTSWAILDLLDKLKKNGQAILCT

SEQ ID NO: 10202 - protein, 154 aa, Alternaria alternata
TLLDVLATRVTMGVVSGEMLVDGNPTDQSFQRKTGYVQQQDLHLSTSTVREALEFSALLRQPASVSRKEKIDYADEVIKLLGMEAYADAVVGVPGEGLNVEQRKRLTIGVELAAKPQLLLFLDEPTSGLDSQTSWSILDLIDTLTKHGQAILCT

SEQ ID NO: 10203 - protein, 505 aa, Populus balsamifera subsp. trichocarpa x Populus deltoides
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 10204 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 10205 - protein, 456 aa, Bilophila wadsworthia
MTYDKAELVALDKKYVWHHLTQHKNFEPAIYVKGEGMRITDIDGKTYLDAVSGGVWTVNVGYGRKEIVDAVAKQMMEMCYFANGIGNVPTIKFSEKLISKMPGMSRVYLSNSGSEANEKAFKIVRQIGQLKHGGKKTGILYRARDYHGTTIGTLSACGQFERKVQYGPFAPGFYEFPDCDVYRSKFGDCADLGVKMAKQLEEVILTVGPDELGAVIVEPMTAGGGILVPPAGYYETIREICDKYELLLIIDEVVCGLGRTGKWFGYQHFNVQPDIVTMAKGVASGYAPISCTVTTEKVFQDFVNDPADTDAYFRDISTFGGCTSGPAAALANIEIIERENLLENCTKMGDRLLEGLKGLMAKHPIIGDVRGKGLFAGIEIVKDRATKEPIAEAVANAMVGAAKQAGVLIGKTSRSFREFNNTLTLCPALIATEADIDEIVAGIDKAFTTVEQKFGL

SEQ ID NO: 10206 - protein, 122 aa, Allium cepa
GYLKKGRYAQRVGTGAPVYLAAVLEYLAAEVLELAGNAAKDNKKNRIIPRHVLLAIRNDEELGKLLGGVTIAHGGVLPNINPVLLPKKIAAKGIRDSKSPKKTAAKSPKKVAAENTQKSVAA

SEQ ID NO: 10207 - protein, 429 aa, Pantoea agglomerans
MTQDDLAFDRRHIWHPYTSMTSPLPVYPVQSAQGCELQLASGEQLVDGMSSWWAAIHGYNHPHLNAAMKTQIEAMSHVMFGGITHAPAVSLCRKLVAMTPEALECVFLADSGSVAVEVSMKMALQYWQAKGESRRRFLTFRRGYHGDTFGAMSACDPDNSMHSLWAGYLPDNLFAPAPESRFDGEWDERDIVGFARLMAAHRHEIAAVILEPIVQGAGGMRLYHPEVLKRIRRMCDREGILLIADEIATGFGRTGKLFACEHADITPDILCLGKALTGGTMTLSATLTTRAVAETIRNGEAGCFMHGPTFMGNPLACAVANASLELLARGEWQVQVAAIEAQLKRELAPARAAETVADVRVLGAIGVIETHQPVNMAALQRFFVEQGVWIRPFGKLIYLMPPYVISPEQLSKLTDAVLAAVAHPAHFAP

SEQ ID NO: 10208 - protein, 161 aa, Hordeum vulgare subsp. vulgare
MADVEYRCFVGGLRWATDDQSLQNAFSKYGDVIDSKIITDRETGRSRGFGFVTFASDEAMRQAIEAMNGQDLDGRNITVNEAQSRRSDGGGGFGGGGGGYGGQRREGGGGGYGGGGGGYGGGRSGGGGGYGSRDGGGGGYGGGGGGYGGSRGGSGGGNWRE

SEQ ID NO: 10209 - protein, 465 aa, Vibrio cholerae O139
MKICPVVLSGGVGSRLWPLSREHFPKQCLNLTDLLSSLLQQTLVRTNHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPMRAETGYGYIKAGQDSCVEKFVEKPDLATAQSYLESGDYLWNSGMFLFQASQYLAELKQHRPAMYAAVESAYGNRTEDLDFIRIGTEAFTACPSESIDYAIMEPTQNAKVVPYNGDWSDIGAWDALHDYCEKDSNHNVLVGDVMAESTTNSLVRAESRLVATVGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFSDRYGR

SEQ ID NO: 10210 - protein, 1033 aa, Kluyveromyces lactis
MSDGGIEIDFQAFYDRFTKLGKAYSGFEGSPNSLLFVLGSTNEENPYQKTTILHNWLLGYEFPATLIAFFKDKGVIITSSAKAKHLLPAVTKFEGSDYKLEIWQRNNKDANHNKKLFEDLIKLLSENGNTVGVPTKDSYQGKLILEWKPLWEEAKKDAFFNVIDCSAGLSSTWKGKDDKEKAYLSVSSKGSDKFMDLMSNEIVNAVDEELKISNSKLSDKIENKIDDSKFLKKLSSDLNPLCPTDEKFDVNFLDWAYSPIVQSGSKFDLKVSARSNNDSLFGKGSILASCGIRYKNYCSNITRTFLIDPTDEMTDNYDFLLILQEKIIDDLLKVEADPTSIYEKTLEFIKEKKPELLSHFTKNVGSLMGLEFRDSAGMINAKPTAHKISENCCYNISLGFGNLKDSKTGQVYAVQLADTVQLSSDGKPSTLTKYTKARSQISFYFNNEEENKAATVKSEKSKPPALPKPDGTSKILRSKLRGESRADDEEKEQIRKENQRKLHERLQKEGLLRYSDADAVDGDEKPKHFFKKYESYVRETQIPSNVRDLKIHVDWKSQTIILPIYGRPVPFHINSYKNGSKNEEGEYTYLRLNFHSPGAGGVGKKTEELPYEENPENQFVRSLTLRSKDGARMSDVFKQITDLKKESTKREQERKALADVVVQAKLVENKTGRTKRLDQIFVRPSPDTKRVPGTVFIHENGIRYQSPLRTDSRIDILFSNIKNLFFQSSKGELIVIIHVHLKNPILMGKKKIQDIQFYREASDMAVDETGNSRRNNMKFRRYGDEDELEQEQEERRKRAALDKEFRYFAEAIAEASDGLLDVDSPFRDLGFQGVPSRSAVFCMPTRDCLIQLVEPPFLVINLNEVEICILERVQFGLKNFDMVFVYKDLTKPVSHINTVPIEQLEFIKTWLTDVDIPYTVSTINLNWSTIMKSLQDDPHQFFLDGGWSFLATGSDDERSDESEEEISEYEASDEDPSDEEVYSEEEEDYSDDEKFSDEGSDDFADGSEDDEGDDWDDLEKKAAKADRNSNYKE

SEQ ID NO: 10211 - protein, 293 aa, Saccharomyces cerevisiae
MAQEITHPTIVDGWFREISDTMWPGQAMTLKVEKVLHHEKSKYQDVLIFKSTTYGNVLVLDNVIQATERDEFAYQEMIAHLALNSHPNPKKVLVIGGGDGGVLREVVKHDSVEEAWLCDIDEAVIRLSKEYLPEMAASYSHPKVKTHIGDGFQFLRDYQNTFDVIITDSSDPEGPAETLFQKEYFQLLNSALTEKGVITTQAESMWIHLPIIKDLKKACSEVFPVAEYSFVTIPTYPTGTIGFMVCSKDKTCNVKKPLREISDEKEAELYRYYNKKIHEASFVLPTWAAKELN

SEQ ID NO: 10212 - protein, 196 aa, Cichorium intybus x Cichorium endivia
GHNNLNAKFVLLGDMGAGKSSLVLRFVKGQFLEFQVSTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 10213 - protein, 196 aa, Cichorium intybus x Cichorium endivia
GHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKREVTAEEARVYAEENGLFFMETSAKTAANVNDVFHEIAKRLPRAQPTQNPAGMVLVDRPAEGARAASCCS

SEQ ID NO: 10214 - protein, 200 aa, Cichorium intybus x Cichorium endivia
MATIGHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 10215 - protein, 200 aa, Cichorium intybus x Cichorium endivia
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 10216 - protein, 497 aa, Arabidopsis thaliana
MAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 10217 - protein, 466 aa, Arabidopsis thaliana
MTSDRFWRGGDRVEVERLVSGATAYFPASVVSAPSVRKKLVWVEHESLTVGGSVSVRMKEYVTPTRLRPSPPRELNRRFKADDEVDVFRDSEGCWVRGNVTTVLEDSRYIVEFKGENRPEIEVDQFNLRLHREWLDGGWVPSLLQQSNFSESTAQRIKLKIKIKRRDQYEKGALVEVRSEEKAYKGSWYCARILCLLGDDKYIVEHLKFSRDDGESIPLRDVVEAKDIRPVPPSELSPVVCYEPGVIVDAWFNKRWWTSRVSKVLGGGSNKYSVFIISTGEETTILNFNLRPHKDWINGQWVIPSKVLTDVPEECYKPPLKKLKSCERAEKVFNNGMEVEVRSDEPGYEASWFSAKIVSYLGENRYTVEYQTLKTDDERELLKEEARGSDIRPPPPPLIPKGYRYELYELVDAWYNEGWWSGRVYKINNNKTRYGVYFQTTDESLEFAYNDLRPCQVWRNGKWSRV

SEQ ID NO: 10218 - protein, 399 aa, Arabidopsis thaliana
MFSAVRFFFFSDLYSSLNLNHGFGFTLQFWISCSFKTLFDLYECFILLGTLLADCVLNLFDFLVIFRTQIGKNFDMEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKNPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 10219 - protein, 297 aa, Arabidopsis thaliana
METPYPKLIDPSKTRIGWIGIGIMGSAMVSHIIAAGYSVTVYARDLRKTKDLQTKGARIANSPKELAEMSDVVFTIVGNFNDVRSLLLGDDGVLSGLTPGGVTVDMTSSKPGLAREIHAEARRRNCWAVDAPVSGGDAGAREGTLGIFAGGDSEIVEWLSPVMKNIGTVTYMGEAGSGQSCKIGNQIAGASNLVGLAEGIVFAEKAGLDTVKWLEAVKDGAAGSAVMRLFGEMIVKRDYRATGFAEYMVKDLGMAAEAAMPGAALSKQLFTGMVANGDGKLGIQGVVSVIRRLNGIS

SEQ ID NO: 10220 - protein, 133 aa, Arabidopsis thaliana
MAKKWQQRAALHRKRISFQRSNVFTSSSSTVEKGCFVVYTADKIRFAFPISYLSNSIVQELLKISEEEFGLPTEGPITLPFDSVFLEYLIKLIQRRMDGDTEKALLMSISSAKCSLQCSLLQQEQSTQQLLVL

SEQ ID NO: 10221 - protein, 132 aa, Arabidopsis thaliana
MAKKWQQRAALHRKRISFQRSSSATSSTAAEKGCFVVYTTDSTRFAFPLSYLSNSVFQELLKISEEEFGLPTGGPITSPFDSVFLEYLIKLVQRRMDADTEKALLMSISSARCSSQCSLKLQERSTQQLLVF

SEQ ID NO: 10222 - protein, 139 aa, Arabidopsis thaliana
MAKKWQQRAALKRKRISFQRSTTTTTTTTTTTSSSTAVEKGCFVVYTVDKIRFAFPLSYLNNSVFEELLKISEEEFGLRAGGPITLPFDSVFLEYLIKFIERRMDGDTEKALLMSISSARCSMQPQEQQSGYTQQLLVF

SEQ ID NO: 10223 - protein, 441 aa, Arabidopsis thaliana
MSRWLFIPTKKKLLSGSHRFCDFVEKTFALLSNSPIKKVSVCHIRICECDCHETYHRWIWTAMERGLLELHLHAESFLFVERELFTSKTLVKLTLSAGYDFEAERVFLPALKSLYLLTDSGIDYDNHCRLLDGCPALEELFIRDADHDCPPCCGSVVKSASIKRLVVLVNLPNKRDSHDYAYFEAPSLVYLDYSSYVYETYQIVGLDSLVEARLSLKIWDYYDYNYDYEYDDESGDYYSDDDEGRSYCYSYVDDERKEPIFGDVTNLLAGVTNITTLHLSPDSLEAFYFCCKSMPVFNKLLNLFIESNKDKGWQGMPLLLKSCPILHTLVFKGLVHRVTNKCGDACACIPKKEKRENEKKNRKIVEKKLSCLWTCQVKVLEISKYDGSFQELKQMGHLLGKLGCLESVKVGVHADNNTEFLQANLLALPRLSSKCNNIQFS

SEQ ID NO: 10224 - protein, 502 aa, Solanum tuberosum
MQFLSLASIFLFLSFLFLLRKWKNSNSQSKKLPPGPWKLPLLGSMLHMAGGLPHHVLRDLAKKYGPLMHLQLGEVSAVVVTSPDMAKEVLKTHDIAFASRPKLLAPEIVCYNRSDIAFCPYGDYWRQMRKICVLELLSAKNVRSYGSIRRDEVDRLVNFIRSSSGEPVNFTERLFLFTSSMTCRSAFGKVFKEQDKFIQLIKEVIGLAGGFDVADIFPSLKFLHVLSGMKGKIMNAHHKVDAIVEDVINEHKKKFAIGKTNGALGGEDLIDVLIRLMNDGGLQFPITNDNIKAIIFDMFAAGTETSSSTLVWAMVQMMKNPSVIAKAQAEVREAFKDKETFDENDVEELKYLKLVIKETLRLHPPVPLLVPRECREETDINGYTIPVKTKVMVNVWALGRDPKYWDDAESFKPERFEQRSVDFVGNNFEYLPFGGGRRICPGISFGLANVYLPLAHLLYHFDWKLPIGMEPKDLNLTELVGVTAARKDDLILVATPYEPPRQ

SEQ ID NO: 10225 - protein, 387 aa, Emericella nidulans
MAAPPAPQPPSLLGYHRVLSPLAGIRVSPLCLGTMHFGGQWMRAMGDVTKETAFALLDRFYEAGGNFIDTANFYQGEGSEKWLGEWVASRGNRDELVLATKYTMSYRLTGPEKIKSNFQGSHSKSLRLSVEASLAKLRTDYIDLLYVHMWDFSTSVEEVMQSLHHLVAAGKVLNIGISDAPAWVVAKCNEYARFHGLTRFCVYQGRWACSYRDFEREILPMCQSEGLALAPWGALGRGQYKSAEEFQQEGTRNMGPQEEKHRLMGAKLTEVGERKGVAAAAIALAYLLHKSPYVFPVIGCRTVEQLEANITSLGVELSDEEIYEIEDTIPFDVGFPMAFLFESPQQKYRSDMTTRHIWQVTCNARIESVPKPRPIEPKQGYKQMDRK

SEQ ID NO: 10226 - protein, 204 aa, Pichia pastoris
MASRGTSRQQYDLTMKLLLVGDSGVGKSCLLLRFVDDSFNPSFITTIGIDFKIRTVEINGKKVKLQIWDTAGQERFRTITTAYYRGAMGIILVYDVTDERSFNSVHNWYQTLNQHANEDAQLFLVGNKCDDEESRQVTKEQGEQLASELGVPFLEASAKSNKNVDAIFLELAKRFEEKMRNTQQGPGSAGIDVNSSNDTKSSCC

SEQ ID NO: 10227 - protein, 189 aa, Bacillus subtilis
MEMMGMENIQQNQGLKQKDEQFVWHAMKGAHQADSLIAQKAEGAWVTDTDGRRYLDAMSGLWCVNIGYGRKELAEAAYEQLKELPYYPLTQSHAPAIQLAEKLNEWLGGDYVIFFSNSGSEANETAFKIARQYHLQNGDHSRYKFISRYRAYHGNTLGALSATGQAQRKYKYEPLSQGFLHAAPPDIYR

SEQ ID NO: 10228 - protein, 398 aa, Chlorobium limicola
MAKILEGPAMKLFNKWGIPVPNYVVIMDPDRLAQLGEANKWLRESKLVVKAHEAIGGRFKLGLVKIGLNLEQAIEAAKEMLGAKVGTAEIGQVIIAEMLEHDAEFYVSIIGNKDGAELLISKHGGVDIEDNWDSVRRIQIELDENPTIEQLTELAKDAGFEGEIAERVGKICSRLILCFDNEDAQSIEINPLVIRKSDMRFAALDAVMNVDYDARFRHADWDFKPVSEIGRPFTEAEQQIMEIDSRIKGSVKFVEVPGGEIALLTAGGGASVFYADAVVARGGTIANYAEYSGDPADWAVEALTETICRLPNIKHIIVGGAIANFTDVKATFSGIINGFRESKSKGYLEGVKIWVRRGGPNEAQGLAAIKQLQEEGFDIHVYDRSMPMTDIVDLAMKS

SEQ ID NO: 10229 - protein, 462 aa, Mitthyridium constrictum
KAGVKDYRLTYYTPDYQTSETDILAAFRMTPQPGVPPEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFVAEALYKSQSETNEIKGHYLNATAGDCDEMLKRAQFARELGVPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVAVEACVQARNEGRDLAREGNEIIREAAKWSPELAAACEVWKEIKFEFETIDTV

SEQ ID NO: 10230 - protein, 462 aa, Syrrhopodon fimbriatulus
KAGVKDYRLTYYTPDYQTLETDILAAFRMTPQPGVPPEEAGAAVAAESSTGTWTTVWTDGLTSLDRYKGRCYDIEAVRGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFVAEALYKAQAETNEIKGHYLNATAGDCDEMLKRAQFARELGVPIVMHDYLTGGFTANTTLSHYCRDNGLLLHIHRAMHAVIDRQKNHGMHFRVLAKALRLSGGDHIHAGTVVGKLEGEREVTLGFVDLLRDDYIEKDRSRGIYFTQDWVSLPGILPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 10231 - protein, 462 aa, Calymperes palisotii
KAGVKDYRLTYYTPDYQTSETDILAAFRMTPQPGVPPEEAGAAVAAESSTGTWTTVWTDGLTSLDRYKGRCYDIEAVAGEENQYIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFVAEAIYKSQAETNEIKGHYLNATAGDCEEMIKRAQFARELGVPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVAVEACVQARNEGRDLAREGNEIIREAAKWSPELAAACEVWKEIKFEFETIDTV

SEQ ID NO: 10232 - protein, 462 aa, Octoblepharum albidum
KAGVKDYRLTYYTPDYQTKDTDILAAFRMTPQPGVPAEEAGAAVAAESSTGTWTTVWTDGLTSLDRYKGRCYDLEAVAGEDNQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGHCDEMLKRAAFARELGAPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGIFPVASGGIHVWHMPALTEIFGDDSVLQFGGGTLGHPWGNAPGAVANRVAVEACVQARNEGRDLAREGNEIIREAAKWSPELAAACEVWKEIKFEFDTIDTV

SEQ ID NO: 10233 - protein, 462 aa, Macromitrium incurvifolium
KAGVKDYRLTYYTPDYQTTETDILAAFRMTPQPGVPAEEAGAAVAAESSTGTWTTVWTDGLTSLDRYKGRCYDIEAVAGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFIAEAIYKSQAETGEIKGHYLNATAGTCEEMMKRAACARELGMPIVMHDYLTGGFTANTSLAHYCRDNGLLLHIHRAMHAVIDRQKNHGMHFRVLAKALRLSGGDHIHAGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTL

SEQ ID NO: 10234 - protein, 462 aa, Hypodontium pomiforme
KAGVKDYRLTYYTPDYQTKETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTCEEMLKRAEFARELGVPIIMHDYLTGGFTANTSLAYYCRDNGLLLHIHRAMHAVIDRQKNHGMHFRVLAKALRLSGGDHVHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 10235 - protein, 462 aa, Hypodontium dregei
KAGVKDYRLTYYTPDYQTKETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFIAEAIYKSQAETGEIKGHYLNATAGTCEEMLKRAEFARELGVPIIMHDYLTGGFTANTSLAYYCRDNGLLLHIHRAMHAVIDRQKNHGMHFRVLAKALRLSGGDHVHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 10236 - protein, 462 aa, Pseudosymblepharis schimperiana
KAGVKDYRLTYYTPDYQTLETDILAAFRMTPQPGVPAEEAGAAVAAESSTGTWTTVWTDGLTSLDRYKGRCYDIEAVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALFKSQAETGEIKGHYLNATAGTCEEMLKRAQFARELGVPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVALEACVQARNEGRDLAREGNDVIREAAKWSPELAAACEVWKEIKFEFETIDTV

SEQ ID NO: 10237 - protein, 462 aa, Leucobryum tahitense
KAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGTCEEMLKRAEFARELGVPIVMHDYLTGGFTANTSLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 10238 - protein, 462 aa, Paraleucobryum enerve
KAGVKDYRLTYYTPDYQTKETDILAAFRMTPQPGVPPEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGPDFTKDDENVNSQPFMRWRDRFLFVAEAIYKSQAETGEIKGHYLNATAGTCEEMLKRAEFARESGVPIVMHDYLTGGFTANTSLAHYCRDNGLLLHIHRAMHAVIDRQKNHGMHFRVLAKALRLSGGDHIHAGTVVGKLEGERQVTLGFVDSLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 10239 - protein, 462 aa, Paraleucobryum longifolium
KAGVKDYRLTYYTPDYQTKETDILAAFRMTPQPGVPPEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGPDFTKDDENVNSQPFMRWRDRFLFVAEAIYKSQAETGEIKGHYLNATAGTCEEMLKRAEFARESGVPIVMHDYLTGGFTANTSLAHYCRDNGLLLHIHRAMHAVIDRQKNHGMHFRVLAKALRLSGGDHIHAGTVVGKLEGERQVTLGFVDSLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPDLAAACEVWKEIKFEFETIDTV

SEQ ID NO: 10240 - protein, 462 aa, Brothera leana
KAGVKDYRLNYYTPDYETSETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGTCEEMLKRAEFARELGVPIIMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 10241 - protein, 429 aa, uncultured bacterium pCosAS1
MTTDDLAFDRQHIWHPYTSMTQPLPVYPVVEAHGCELTLASGEQLVDGMSSWWAAIHGYNHPRLNAAMKAQIDRMSHVMFGGITHQPAVDLCRRLVAMTPETLECVFPADSGSVAVEVAMKMALQYWHAKGESRQRFITFRNGYHGDTFGAMSVCDPDNSMHSLWKGYLPENLFAPAPQSRFDGAWDEMDMVGLAPLMAAHRHEIAAVILEPIVQGAGGMRMYHPEWLKRIRRMCDREGILLIADEIATGFGRTGKLFACEHAGITPDILCLGKALTGGTMTMSATLTTRQVAETISNGEAGCFMHGPTFMGNPLACAVASESLALLESGEWQDQVAAIESQLQEELAVARDSEFVADVRVLGAIGVVETTHPVNMAALQRFFVARGVWVRPFGKLIYLMPPYVIRPDQLSKLTRAVVDAVQAPAHFTR

SEQ ID NO: 10242 - protein, 410 aa, Blumeria graminis
MSDMQGRKVFKVFNQDFVVDERYNVTKELGQGAYGIVCAATNISTQEGVAIKKVTNVFSKKILAKRALREIKLLQHFRGHRNITCLYDMDIPRPENFNETYLYEELMECDLAAIIRSGQPLTDAHFQSFIYQILCGLKYVHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHVLGTPNEETLARIGSPRAQEYVRNLPFMAKRPFAQIFPNANPDALDLLNRMLAFDPASRISVEEALEHPFLQIWHDVSDEPCCPTTFNFDFEVTDDVGEMRKMILDEVARFRHHVRVQPGMQSPSNDPSVPTLQTSVAWGSEDPRPQENNDQEITGLERDLTVGLDR

SEQ ID NO: 10243 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYIFAETALDRGEVVEILAKFFPEYPLPTKCSDEKNPRAKPYKFTTQKIKDLGLEFKPIKQSLYESVKSLQEKGHLPLPQDSNQNEVIIES

SEQ ID NO: 10244 - protein, 406 aa, Comamonas testosteroni
MGNEESIGSVLVVGGGLASVSFVNPLRGAGFSGDVRVIEAETEPAYDRPPLSKEFLRDGEPTNIRLDTSRAPGVEWLHGHSVSAIETARSVVRLSNGSELAYGTLVLATGARPPSCLLCAASGLQLFTLRTLDDAKQIRSTLKPGARLLVVGGGVIGLELAANARGLGCEVMIVEATDRLMNRCSPATLSNLMADCHRAHGIDLRLKTQVRDIRHGSVLLDDGTTFAADRMVIGIGVVAKQQLASAAGIAWHDGIFVDGFGRTTCPRVLAIADVTRQRNPVSGRFERIETWSNAQNQGAAVAGALVAESPLPYADPPWFWSDQFEMKIQVAGLATGDSRNHSRPSCRRWKVRADSGPQGRAVGVTCVNNAREFVSLKRLLTFDGLPDVSELANPTNDLRKLLQASA

SEQ ID NO: 10245 - protein, 289 aa, Saccharomyces chevalieri
MSNESNDLEKNISHLDPTGVDNAYIPPEQPETKHSRFNIDRDTLRNHFIAAVGEFCGTFMFLWCAYVICNVANHDVALTTEPEGSHPGQLIMIALGFGFSVMFSIWCFAGVSGGALNPAVSLSLCLARAISPARCVVMWFSQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWIGPLLGAFLAWSVWQLLQILDYTTYVNAEKAAGQKKED

SEQ ID NO: 10246 - protein, 443 aa, Escherichia coli O157:H7 EDL933
MQPSRNFDDLKFSSIHRRILLWGSGGPFLDGYILVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 10247 - protein, 457 aa, Escherichia coli O157:H7 EDL933
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 10248 - protein, 426 aa, Escherichia coli O157:H7 EDL933
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPDFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 10249 - protein, 380 aa, Escherichia coli O157:H7 EDL933
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGIELHGAHGFLLQNFFSPLFNQRNDRWGGDLEGRMRFPLAVLQEVKNVVYEYATKPFAIGYRISPEESATGGLRIEDTYKLLDRLISSGISYIHTSLVSINDSYPVESPNGPRTIELILNHIAGRVPVIAAGKIRTPSQAQEAISTGLPLVAIGKGLVINPEWVTLAESGRGHEIQTTLNPQLVPELTIPDKLWDQIQASKGTGWFPLMD

SEQ ID NO: 10250 - protein, 450 aa, Escherichia coli O157:H7 EDL933
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVINGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREERDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 10251 - protein, 490 aa, Escherichia coli O157:H7 EDL933
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGDGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 10252 - protein, 349 aa, Escherichia coli O157:H7 EDL933
MKIKAVGSYSAKQPLEPMDITRREPGPNDVKIEIAYCGVCHSDLHQVRSEWAGTVYPCVPGHEIVGRVVAVGDQVEKHAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 10253 - protein, 369 aa, Escherichia coli O157:H7 EDL933
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 10254 - protein, 352 aa, Escherichia coli O157:H7 EDL933
  misc_feature (127)..(127): Xaa can be any naturally occurring amino acid
  misc_feature (130)..(130): Xaa can be any naturally occurring amino acid
MERTMSQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVSRSEVKQRVKEALAXVDXEGFEDRYVDQISGGQQQRVALARALILKPKVLLFDEPLSNLDANLRRSMRDKIRELQKQFNITSLYVTHDQSEAFAVSDTVLVMNKGHIMQIGSPQDLYRQPASRFMASFMGDANLFPANFSEEYVDIYGYRLPRAAHFPVQGSGTVGVRPEAITLSNHGEESQRCVIRHVAYMGPQYEVTVEWHGQEILLQVNATRLQPDIGEHYYLEIHPYGMFVLADAA

SEQ ID NO: 10255 - protein, 434 aa, Escherichia coli O157:H7 EDL933
MHARSAREINQCYRTLRPRLLMCMIIGYAAFYLTRKSVNYVLPALQTDLGLDKGDIGLLGSLFYLSYGLSKFTAGLWHDSHGQRGFMGVGLFATGLLNVVFAFGESLTLLLVVWTLNGFFQGWGWPPCARLLTHWYSRNERGFWWGCWNMSINIGGAIIPLISAFAAHWWGWQAAMLTPGIISMALGIWLTLQLKGTPQEEGLPTVGHWRHDPLELRQEQQSPPMGLWQMLRTTMLQNPLIWLLGVSYVLVYVIRIALNDWGNIWLTESHGVNLLSANATVMLFEVGGLLGALFAGWGSDLLFSGQRAPMILLFTLGLMVSVAALWLAPVHHYALLAVCFFTVGFFVFGPQMLIGLAAVECGHKAAAGSITGFLGLFAYLGAALAGWPLSLVIERYGWPGMFSLLSVAAVLMGLLLMPLLMAGITTTHARRIKQ

SEQ ID NO: 10256 - protein, 319 aa, Escherichia coli O157:H7 EDL933
MKPENKLPVLDLISAEMKTVVNTLQPDLPPWPATGTIAEQRQYYTLERRFWNAGAPEMATKAYMVPTKYGQVETRLFCPQPDSPATLFYLHGGGFILGNLDTHDRIMRLLASYSQCTVIGIDYTLSPEARFPQVIEEIVAACCYFHQQAEDYQINMSRIGFAGDSAGAMLALASALWLRDKQIDCGKVAGVLLWYGLYGLRDSVTRRLLGGVWDGLTQQDLQMYEEAYLSNDADRESPYYCLFNNDLTREVPPCFIAGAEFDPLLDDSRLLYQTLAAHQQPCEFKLYPGTLHAFLHYSRMMKTADEALRDGAQFFTAQL

SEQ ID NO: 10257 - protein, 310 aa, Escherichia coli O157:H7 EDL933
MLDANKLQQAVDQAYTQFHSLNGGQNADYIPFLANVPGQLAAVAIVTSDGNVYSAGDSDYRFALESISKVCTLALALEDVGPQAVQDKIGADPTGLPFNSVIALELHGGKPLSPLVNAGAIATTSLINAENAEQRWQRILHIQQQLAGELVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 10258 - protein, 292 aa, Escherichia coli O157:H7 EDL933
MKLGFIGLGIMGTPMAINLARAGHQLHVTTIGPVADELLSLGAVNVDTARQVTEAADIIFIMVPDTPQVEEVLFGENGCTKASLKGKTIVDMSSISPIETKRFARQVNELGGDYLDAPVSGGEIGAREGTLSIMVGGDEAVFERVKPLFELLGKNITLVGGNGDGQTCKVANQIIVALNIEAVSEALLFASKAGADPVRVRQALMGGFASSRILEVHGERMIKRTFNPGFKIALHQKDLNLALQSAKALALNLPNTATCQELFNTCAANGGSQLDHSALVQALELMANHKLA

SEQ ID NO: 10259 - protein, 458 aa, Escherichia coli O157:H7 EDL933
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 10260 - protein, 240 aa, Escherichia coli O157:H7 EDL933
  misc_feature (29)..(29): Xaa can be any naturally occurring amino acid
MIEFKNVSKHFGPTQVLHNIDLNIAQGEXVVIIGPSGSGKSTLLRCINKLEEITSGDLIVDGLKVNDPKVDERLIRQEAGMVFQQFYLFPHLTALENVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGDPQVLIKNPPSQRLQEFLQHVS

SEQ ID NO: 10261 - protein, 231 aa, Escherichia coli O157:H7 EDL933
MFRKLAAECFGTFWLVFGGCGSAVLAAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRN

SEQ ID NO: 10262 - protein, 1320 aa, Escherichia coli O157:H7 EDL933
  misc_feature (174)..(174): Xaa can be any naturally occurring amino acid
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLXIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSTVSERIQLAKAENITAQPFDAVIFHGDSDQLRALCEAVAARDGAIVSVQGFARGESNILLERLYIERSLSVNTAAAGGNASLMTIG

SEQ ID NO: 10263 - protein, 470 aa, Escherichia coli O157:H7 EDL933
MTHKGDTPMTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVTQMIKDSRIAAITVTGSVRAGAAIGAQAGAALKKCVLELGGSDPFIVLNDADLELAVKAAVAGRYQNTGQVCAAAKRFIIEEGIASAFTERFVAAAAALKMDDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 10264 - protein, 1015 aa, Escherichia coli O157:H7 EDL933
  misc_feature (196)..(196): Xaa can be any naturally occurring amino acid
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQFDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLAGQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQAEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 10265 - protein, 474 aa, Escherichia coli O157:H7 EDL933
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTVACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 10266 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 10267 - protein, 421 aa, Escherichia coli O157:H7 EDL933
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERAMQLGQRLTKTLIDAKENVPAIAAVRGLGSMIAAEFNDPQTGEPSAAIAQKIQQRALAQGLLLLTCGAYGNVIRFLYPLTIPDAQFDAAMKILQDALRD

SEQ ID NO: 10268 - protein, 495 aa, Escherichia coli O157:H7 EDL933
MNFHHLAYWQDKALSLAIENRLFINGEYTAAAENETFETVDPVTQAPLANIARGKSVDIDRAVSAARGVFERGDWSLSSPAKRKAVLNKLADLIEANAEELALLETLDTGKPIRHSLRDDIPGAARAIRWYAEAIDKVYGEVATTSSHELAMIVREPVGVIAAIVPWNFPLLLTCWKLGPALAAGNSVVLKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIQEGESKGQLLLDGRNAGLAVAIGPTIIVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 10269 - protein, 498 aa, Escherichia coli O157:H7 EDL933
MHTDSNGGHYILRFDNERKTNQRRRIMETNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 10270 - protein, 461 aa, Escherichia coli O157:H7 EDL933
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVAMSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYEGDRTPVSET

SEQ ID NO: 10271 - protein, 268 aa, Escherichia coli O157:H7 EDL933
MERYESLFAQLKERKEGAFVPFVTLGDPGIEQSLKIIDTLIEAGADTLELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPKKMLAALKAFVQPMKAATRS

SEQ ID NO: 10272 - protein, 365 aa, Escherichia coli O157:H7 EDL933
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMAVQLWHTGRISHASLQPGGQAPVAPSALSAGTRTSLRDENGQAIRVETSMPRALELEEIPSIVNDFRQAIANAREAGFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 10273 - protein, 401 aa, Escherichia coli O157:H7 EDL933
MRRWVLSCLKRLINRSITMDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 10274 - protein, 183 aa, Escherichia coli O157:H7 EDL933
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLISAAPTAVAPEESGFYARMVSKGRAPLYPDDILWNFEKFLVGRDGLVIQRFSPDMTPEDPIVMESIKLALAK

SEQ ID NO: 10275 - protein, 406 aa, Escherichia coli O157:H7 EDL933
MSQPITRENFDEWMIPVYAPAPFIPVRGEGSRLWDQQGKEYIDFAGGIAVNALGHAHPELREALNEQASKFWHTGNGYTNESVLRLAKKLIDATFADRVFFCNSGAEANEAALKLARKFAHDRYGSHKSGIVAFKNAFHGRTLFTVSAGGQPAYSQDFAPLPPDIRHAAYNDINSASALIDDSTCAVIVEPIQGEGGVVPASNAFLQGLRELCDRHNALLIFDEVQTGVGRTGELYAYMHYGVTPDLLTTAKALGGGFPVGALLATEECASVMTVGTHGTTYGGNPLASAVAGKVLELINTPEMLNGVKQRHDWFVERLNIINHRYGLFNEVRGLGLLIGCVLNADYAGQAKQISQEAAKAGVMVLIAGGNVVRFAPALNVSEEEVTTGLDRFAVACEHFVSRGSS

SEQ ID NO: 10276 - protein, 326 aa, Escherichia coli O157:H7 EDL933
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVEASLQRLGFDYIDIYMTHWQSVPPFYTPIAETVAVLNELKAEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEVLGR

SEQ ID NO: 10277 - protein, 459 aa, Escherichia coli O157:H7 EDL933
MDQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRHTGKPLPPVVIADDGKAPQAVPYSALLTGVLLKRVILGSCVLIAMNVVQYTLINWLPTIFMTQGINLKDSIVLNTMSMFGTPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 10278 - protein, 480 aa, Escherichia coli O157:H7 EDL933
  misc_feature (284)..(284): Xaa can be any naturally occurring amino acid
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGINYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITAXQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 10279 - protein, 266 aa, Escherichia coli O157:H7 EDL933
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDINVQLHTVIAQYPGAELETKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 10280 - protein, 250 aa, Escherichia coli O157:H7 EDL933
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARKLLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGAAKALFADPEQPRTRQFLEKFLLQ

SEQ ID NO: 10281 - protein, 360 aa, Escherichia coli O157:H7 EDL933
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 10282 - protein, 468 aa, Escherichia coli O157:H7 EDL933
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 10283 - protein, 482 aa, Escherichia coli O157:H7 EDL933
MSDAPIIAVVMAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 10284 - protein, 478 aa, Escherichia coli O157:H7 EDL933
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEDAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 10285 - protein, 452 aa, Escherichia coli O157:H7 EDL933
  misc_feature (69)..(69): Xaa can be any naturally occurring amino acid
MTQRRDLQALIDAAPVGKMQWRVIICCFLVVMLDGFDTAAIGFIAPDIRTHWQLTAGDLSPLFGAGLLXLTAGALLCGPLSDRFGRKRVIELCVFLFGALSLASAFSPDLQTLVFLRFLTGLGLGGAMPNTITMTSEYLPARRRGALVTLMFCGFTLGSAFGGIVSAQLVPVIGWHGILVLGGVLPLMLFVALLVVLPESPRWQVRRQLPQAVIAKTVSAITRERYVDTHFYLIESASVTKGSIRQLFMGRQLPITLMLWVVFFMSLLIIYLLSSWMPTLLNHRGIDLQHASWVTAAFQIGGTLGALALGVLMDKFNPFRVLTLSYAIGAICIVMIGLSQDGLWLMALAIFGTGIGISGSQVGLNALTATLYPTQSRATGVSWSNAIGRCGAIVGSLSGGVMMAMNFSFDTLFFIIAVPAAISAVMLTLLITVVRQSTSVPDSLPRAGVVNE

SEQ ID NO: 10286 - protein, 412 aa, Escherichia coli O157:H7 EDL933
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLLRARQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDDFAKLEPQRNTIKTQNYQTRDPQVFAAGDIVEGDKTVVYAVKTGKEAAEAIHHYLEGACSC

SEQ ID NO: 10287 - protein, 489 aa, Escherichia coli O157:H7 EDL933
  misc_feature (57)..(57): Xaa can be any naturally occurring amino acid
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 10288 - protein, 452 aa, Escherichia coli O157:H7 EDL933
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHQELLQKRNGG

SEQ ID NO: 10289 - protein, 257 aa, Escherichia coli O157:H7 EDL933
  misc_feature (246)..(246): Xaa can be any naturally occurring amino acid
MSENKLNVIDLHKRYGEHEVLKGVSLQANAGDVISIIGSSGSGKSTFLRCINFLEKPSEGSIVVNGQTINLVRDKDGQLKVADKNQLRLLRTRLTMVFQHFNLWSHMTVLENVMEAPIQVLGLSKQEARERAVKYLAKVGIDERAQGKYPVHLSGGQQQRVSIARALAMEPEVLLFDEPTSALDPELVGEVLRIMQQLAEEGKTMVVVTHEMGFARHVSTHVIFLHQGKIEEEGAPEQLFGNPQSXRLQQFLKGSLK

SEQ ID NO: 10290 - protein, 305 aa, Escherichia coli O157:H7 EDL933
  misc_feature (23)..(23): Xaa can be any naturally occurring amino acid
MSAKVWVLGDAGRRSLARIRRAXYCLVLAARQLTLPVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 10291 - protein, 412 aa, Escherichia coli O157:H7 EDL933
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAILESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 10292 - protein, 303 aa, Escherichia coli O157:H7 EDL933
MSTLEQTIGNTPLVKLQRMGPNNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMADRGEGKLLDQFNNPDNPYAHYTTTGPEIWQQTGGRITYFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 10293 - protein, 365 aa, Escherichia coli O157:H7 EDL933
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPDQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQRGERLFVGLQHARLYNGDERIEPRDEELALAQSA

SEQ ID NO: 10294 - protein, 171 aa, Escherichia coli O157:H7 EDL933
  misc_feature (144)..(144): Xaa can be any naturally occurring amino acid
  misc_feature (161)..(161): Xaa can be any naturally occurring amino acid
MDYFTLFGLPARYQLDTQALSLRFQDLQRQYHPDKFASGSQAEQLAAVQQSATINQAWQTLRHPLMRAEYLLSLHGFDLASEQHTVRDTAFLMEQLELREELDEIEQAKDEARLESFIKRVKKMFDTRHQLMVEQLDNETWDAXADTVRKLRFLDKLRSSXEQLEEKLLDF

SEQ ID NO: 10295 - protein, 400 aa, Escherichia coli O157:H7 EDL933
MKEKTIIIVGGGQAAAMAAASLRQQGFTGELHLFSDEQHLPYERPPLSKSMLLEDSPQLQSVLPAHWWQENNVHLHSGVTIKTLGRDTRELVLANGESWHWDQLFIATGAAARPLPLLDALGERCFTLRHAGDAARLREVLQPERSVVIVGAGTIGLELAASATQRRCKVTVIELAATVMGRNAPPPVQRYLLQRHQQAGVRILLNNAIEHVVDGEKVELTLQSGETLQADVVIYGIGISANDQLAREANLDTTNGIVIDEACRTCDPAIFAGGDVAITRLDNGALHRCESWENANNHAQIAAAAMLGLPLPLLPPPWFWSDQYSDNLQFIGDMRGDDWLCRGNPETQKAIWFNLQNGVLIGAVTLNQGREIRSIRKWIQSGKTFDAKQLTDENIALKSL

SEQ ID NO: 10296 - protein, 386 aa, Escherichia coli O157:H7 EDL933
  misc_feature (240)..(240): Xaa can be any naturally occurring amino acid
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEXVAQAKSPHVAALGSEAGGTLYGLQVLERIEANQRQNFTRFVVLARKAINVSDQVPAKTTLLMATGQQAGALVEALLVLRNHNLIMTRLESRPIHGNPWEEMFYLDIQANLESAEMQKALKELGEITRSMKVLGCYPSENVVPVDPT

SEQ ID NO: 10297 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 10298 - protein, 426 aa, Escherichia coli O157:H7 EDL933
  misc_feature (4)..(4): Xaa can be any naturally occurring amino acid
  misc_feature (9)..(10): Xaa can be any naturally occurring amino acid
  misc_feature (13)..(13): Xaa can be any naturally occurring amino acid
  misc_feature (243)..(243): Xaa can be any naturally occurring amino acid
MSSXKELMXXRSXAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQXGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFAEAKQ

SEQ ID NO: 10299 - protein, 466 aa, Escherichia coli O157:H7 EDL933
  misc_feature (345)..(345): Xaa can be any naturally occurring amino acid
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 10300 - protein, 474 aa, Escherichia coli O157:H7 EDL933
MSVFPEGFLWGGALAANQSEGAFREGGKGLTTVDMIPHGEHRMAVKLGLEKRFQLRDDEFYPSHEATGFYHRYKEDIALMAEMGFKVFRTSIAWSRPFPQGDELTPNQQGIAFYRSVFEECKKYGIEPLVTLCHFDVPMQLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGAYPAYSARVFREKGVTIDKAPGDDEILKNTVDFVSFSYYASRCASAEMNTNNSSAANVVKSLRNPYLQVSDWGWGIDPLGLRITMNMMYDRYQKPLFLVENGLGAKDELAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 10301 - protein, 432 aa, Escherichia coli O157:H7 EDL933
  misc_feature (144)..(144): Xaa can be any naturally occurring amino acid
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKXSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 10302 - protein, 479 aa, Escherichia coli O157:H7 EDL933
  misc_feature (25)..(25): Xaa can be any naturally occurring amino acid
  misc_feature (247)..(247): Xaa can be any naturally occurring amino acid
MIVKKLTLPKDFLWGGAVAAHQVEXGWNKGGKGPSICDVLTGGAHGVPREITKEVLPGKYYPNHEAVDFYGHYKEDIKLFAEMGFKCFRTSIAWTRIFPKGDEAQPNEEGLKFYDSLFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINLEMKVGCMLAMVPXYPYSCNPDDVMFAQESMRERYVFTDVQLRGYYPSYVLNEWERRGFNIKMEDSDLDVLREGTCDYLGFSYYMTNAVKAEGGTGDAISGFEGSVPNPYVKASDWGWQIDPVGLRYALCELYERYQKPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGENL

SEQ ID NO: 10303 - protein, 387 aa, Escherichia coli O157:H7 EDL933
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDEILSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 10304 - protein, 464 aa, Escherichia coli O157:H7 EDL933
MPDAKKQGQSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAGLNVLFILLTLWLVPETKHVSLEHIERNLMKGRKLREIGAHD

SEQ ID NO: 10305 - protein, 395 aa, Escherichia coli O157:H7 EDL933
  misc_feature (16)..(16): Xaa can be any naturally occurring amino acid
MADKKLDTQLVNAGRXKKYTLGAVNSVIQRASSLVFESMEAKKHATRNRANGELFYGRRGTLTHFSLQQAMCELEGGAGCALFPCGAAAVANSILAFVEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNDEELANYLDNFSLFSMAYSWGGYESLILANQPEHIAAIRPQGEIDFSGTLIRLHIGLEDVDDLIADLDAGFARIV

SEQ ID NO: 10306 - protein, 496 aa, Escherichia coli O157:H7 EDL933
MITTFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 10307 - protein, 445 aa, Escherichia coli O157:H7 EDL933
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVETALGSRGRVLLRKSGTEPLIRVMVEGEDEAQVTEFAHRIADAVKAV

SEQ ID NO: 10308 - protein, 472 aa, Escherichia coli O157:H7 EDL933
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVQAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETREEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHSMEWLAKHSVELDSQGRIIAPEGSDNAFQTSNPKIFAGGDIVRGSDLVVTAIAEGRKAADGIMNWLEV

SEQ ID NO: 10309 - protein, 270 aa, Escherichia coli O157:H7 EDL933
  misc_feature (239)..(239): Xaa can be any naturally occurring amino acid
MKSLFKVTLLATTMAVALHAPITFAAEAAKPATTADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTXVFDVELLDVKPAPKADAKPEADAKAADSAKK

SEQ ID NO: 10310 - protein, 406 aa, Escherichia coli O157:H7 EDL933
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPSDIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGQARDFLYAGAEAGVMVLNAGPDVMRFAPSLVVEDADIDEGMQRFAHAVAKVVGA

SEQ ID NO: 10311 - protein, 450 aa, Escherichia coli O157:H7 EDL933
  misc_feature (393)..(393): Xaa can be any naturally occurring amino acid
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKXVCVGPEEKIVGIHGIGFGMDEMLQGFAVALKMGATKKDFDNTVAIHPTAAEEFVTMR

SEQ ID NO: 10312 - protein, 382 aa, Escherichia coli O157:H7 EDL933
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESDQSAAICEELANFDYLYLSGISLAILSPTSREKLLSLLRECRANGGKVIFDNNYRPRLWASKEETQQVYQQMLECTDIAFLTLDDEBALWGQQPVEDVIARTHNAGVKEVVVKRGADSCLVSIAGEGLVDVPAVKLPKEKVIDTTAAGDSFSAGYLAVRLTGGSAENAAKRGHLTASTVIQYRGAIIPREAMPA

SEQ ID NO: 10313 - protein, 109 aa, Escherichia coli O157:H7 EDL933
MVGVMFLLVMFFSPLVAMVPPYATAGALIFVGVLMTSSLARVNWDDFTESVPAFVTTVMMPFTFSITEGIALGFMSYCIMKVCTGRWRDLNLCVVVVAALFALKIILVD

SEQ ID NO: 10314 - protein, 357 aa, Escherichia coli O157:H7 EDL933
MIIITEPLLSFVLQKQGIKSPPMDKKMNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAIGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALTLELAGIIFSFMLINLFDSSGTLIGVTDKAGLIDSNGKFPNMNKALYVDSVVRWRARLSAPRLLPPILKVLLVWQSVVARG

SEQ ID NO: 10315 - protein, 463 aa, Escherichia coli O157:H7 EDL933
  misc_feature (155)..(155): Xaa can be any naturally occurring amino acid
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRXKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 10316 - protein, 440 aa, Escherichia coli O157:H7 EDL933
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 10317 - protein, 445 aa, Escherichia coli O157:H7 EDL933
MSQQHTTQASGQGMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPGYAAAGALIYVGVLMTSSLARVNWQDLTESVPAFITAVMMPFSFSITEGIALGFISYCVMKIGTGRIRDLSPCVIIVALLFILKIVFIDAH

SEQ ID NO: 10318 - protein, 298 aa, Escherichia coli O157:H7 EDL933
MAAIAFIGLGQMGSPMASNLLQQGHQLRVFDVNAEAVRHLVDKGATPAANPAQAAKDAEFIITMLPNGDLVRSVLFGENGVCESLSTDALVIDMSTIHPLQTDKLIADMQAKGFNMMDVPVGRTSANAITGTLLLLAGGTAEQVERATPILMAMGSELINAGGPGMGIRVKLINNYMSIALNALSAEAAVLCEALNLPFDVAVKVMSGTAAGKGHFTTSWPNKVLSGDLSPAFMIDLAHKDLGIALDVANQLHVPMPLGAASREVYSQARAAGRGRQDWSAILEQVRVSAGMTAKVKM

SEQ ID NO: 10319 - protein, 300 aa, Escherichia coli O157:H7 EDL933
MTMIRVACVGITVMDRIYYVEGLPTESGKYVARNYTEVGGGPAATAAVAAARLGAQVDFIGRVGDDDTGNSLLAELESWGVNTRYTKRYKQAKSSQSAIMVDAKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVVLATGGDLAESVRFASGVAASKCTRPGGRAGIPDCDQTRSFLSLFV

SEQ ID NO: 10320 - protein, 1016 aa, Escherichia coli O157:H7 EDL933
  misc_feature (95)..(95): Xaa can be any naturally occurring amino acid
  misc_feature (196)..(196): Xaa can be any naturally occurring amino acid
  misc_feature (388)..(388): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKXAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFXKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQENYWGNYPKFFVSMMKAFFGDKATAENSWGFDWLPKWDKGYDVLQYFEMMKEGKVNGYICQGFNPVASFPNKNKVISCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPKSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 10321 - protein, 386 aa, Escherichia coli O157:H7 EDL933
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAKAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 10322 - protein, 444 aa, Escherichia coli O157:H7 EDL933
MGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQLLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 10323 - protein, 327 aa, Escherichia coli O157:H7 EDL933
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNINADKAAILPAAISFEQAAASFLKGLTVYYLLRKTYEIKPDEQFLFHAAAGGVGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 10324 - protein, 259 aa, Escherichia coli O157:H7 EDL933
  misc_feature (244)..(244): Xaa can be any naturally occurring amino acid
MMSVVNPPLLYSYGILLLFLFPWDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIXPFSTLVFEVELLEIL

SEQ ID NO: 10325 - protein, 353 aa, Escherichia coli O157:H7 EDL933
MLYTSQTTPEKDQKMSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLPVPAFTLIAGDRSVSGSATGTPYELRKLMRFAARSKVAPTTELFPMSKINDAIKHVRDGKARYRVVLKADF

SEQ ID NO: 10326 - protein, 460 aa, Escherichia coli O157:H7 EDL933
  misc_feature (20)..(20): Xaa can be any naturally occurring amino acid
MAKAPKRAFVCNECGADYPXWQGQCSACHAWNTITEVRLAASPTVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 10327 - protein, 483 aa, Pseudomonas aeruginosa
MNTKLFINNVWINSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 10328 - protein, 398 aa, Musa acuminata
AAFTAPIYSSRAPLTSAAVRDPELVVQEVQRSLNVSRRRLGYLSCGTGNPIDDCWRCDPDWADNRQRLADCAIGFGKNAIGGRDGEIYVVTDSGDDDPVNPKPGTLRYAVIQEEPLWIIFKRDIVIQLKEELIMNSHKTIDGRGASVHISGGPCITIQYVTNIIIHGVHIHDCKQGGNAYVRDSPGHYGWRTVSDGDGVSIFGGQPPSWVDHCTLFNCHDGLIDAIHGSTAITISNNYLRHHDKVMLLGHSDELTSDKSMQVTIAFNHFGEDLVQRMPRCRHGYFHVVNNDYTHWEMYAIGGSAAPTINSQGNRFLAPNDRFAKEVTKREDAQESEWKKWNWRSEGDQMLNGAFFTPSGAGASSSHAKASSLGPRSSSLVGTITVSAGVLSCKKGSRC

SEQ ID NO: 10329 - protein, 1116 aa, Schizosaccharomyces pombe
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 10330 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 10331 - protein, 394 aa, Guillardia theta
MLLLLETINGYSIYKKIKKNNNQSIFNLNSIYEFESSKISENSFVKIQSGKMPKNLKKFLINNSNKDEILIVGDPYIKMYISNNLQLKFKKIVTNKSSIYNLKKKLNETKLDKNYFFSPKLSHIISHNIYSIKLKINSKKLDNMIIYSIKLYEEIEKEIFHYYNIQKEWYSWHFPELSKIVTDPEMYSLLIKRIEKKENLHKIDISDIVDDNIKKNIYQNLKISIGTKIHDDDLNAILILTDHIISMIRIKKMLNEYIKHRMYYSAPNLCSIIGEKIGSKLISAAGSLLNLSKLPASTIQIIGAEKSLYKALKTKGKTPKFGLIYNSRVIQKCSPKLKGKISRILSAKTSICVRVDALGESNLGGCIGIKYREILENRLKQFDSFFNLSINIKK

SEQ ID NO: 10332 - protein, 295 aa, Guillardia theta
MFTIERGIKYIKKKLIDYGTYGKVFEMMKMKIKKCACKEIEIYYSNNSLKKEYISEVRFLSYIFHPNLIFLQNFLYSKNEDKISLIMDFCELNLRNLIENKIKISTNQILFIGLQLLNSIVYLHLNKIIHRDLKSSNILINRLGIVKICDFGMGTFLCSKKICLSDKIVTLWYRAPEILLGQHFYDYSVDMWSFGCVIGELITGEILFQGKSELDQLNKIFQTIGTPTTEIWLNLHTLKFTKNIVFPIQPYNKLNLKLESKTNKNLIFLLQKILVYDPKKRLKSTEALKFFYSFF

SEQ ID NO: 10333 - protein, 262 aa, Picea abies
RLAEPYKGIGDCFGRTIKDEGFIALWRGNTANVIRYFPTQALNFAFKDYFKRLFNFKKDRDGYWKWFAGNLASGGAAGASSLLFVYSLDYARTRLANDSKAAKKGGERQFNGLVDVYKKTLKSDGIAGLYRGFNISCVGIIVYRGLYFGMYDSLKPVVLTGDLQNNFLASFLLGWGITIGAGLASYPIDTVRRRMMMTSGEAVKYKSSLDAFNQIVKNEGTKSLFKGAGANILRAIAGAGVLAGYDQLQLILLGKKYGSGGG

SEQ ID NO: 10334 - protein, 196 aa, Picea abies
ATGRIHKGVCSNWMKNSVPSEKSHDCSWAPVFVRQSNFKLPADPSVPIVMVGPGTGLAPFRGFLQERDALQESGEKLGPAVLFFGCRNRQMDYIYEDELKNYVDNGVLSDLVLAFSREGTTKEYVQHKITEKASYIWNLISQGGYLYVCGDAKGMARDVHRTLHNIVQEQESVDSTSAEATVKKLQTEGRYLRDVW

SEQ ID NO: 10335 - protein, 375 aa, Torenia fournieri
MVSPASPSPARVELLSNSGIKAIPKEYVRTEEELRSITDIFSKEDGAKNIDSPDLPIIDLSKIDSSDEETRKKGHEELKEAAIEWGVMHLINHGISDELINRVKKAGGEFFDLPVEEKEKYANDQSSGNVQGYGSKLANNAGGILEWEDYFFHCVYPEEKRDMAIWPKDPQDYIPATTEYAKEIRSLTTKILSVLSLGLGLDQDRLEKEVGGKDDLTLQMKINYYPKCPQPELALGVEAHTDVSALTFILHNMVPGLQVLYKGEWVTASCVPDSIILHVGDTIEILSNGMYKSVLHRGLVNRERVRVSWAVFCEPPKEKIVLKPLPETVGEDRPALFPPRTFAQHMKHKLFKKSDDEVHDEEGVVVVEHDDKSVE

SEQ ID NO: 10336 - protein, 184 aa, Cladosporium fulvum
MNFMLLSAALASMAVAGPIAGTYPITYPSSNTPATYPSGNAPIWSSPIHGGNNGGNGGNGGDNNGGNGGNGGSGGGNTGGNAGNGGGNNGGNNNGGNNGGNTGGEGGNGGNGGNGGAPVELCPANRVPQCCQLSVLGVADVTCASPSSGLTSVSAFEADCANDGTTAQCCLIPVLGLGLFCSNP

SEQ ID NO: 10337 - protein, 435 aa, Sphingomonas paucimobilis
MNLDRRSFAAAAAAGVLLPHAVRAAPPRVTFPKGFLWGAATAGHQIEGNTSTSDIWLLEQVKPSVFSEPSGDACNSLELWPIDLDLVKSLGLNCYRFSLEWARIEPEPGQFSIAMLNHYKAIVDGCRARGLAPLVTYCHYAAPRWFAARGGWLNPEAPQLFARFCDRATRHLGAGIHTAMTLNEPNIVPMLQVVLPPQAQTIIALTLDGAAKALGVPELAVANTAKQADVPRLTAALLAAHKAGKAAIKAARPDLPVGLTLAMFDDEAVGAPAMRDRMRQQLYGTWLEAARDDDFIGVQNYEKVRWGPEGRLPPPAGAVRNDNGGEVYGPSLANACRYAHAVARVPVLVSEHGVATSDDRIRAKLIPGALVELHKAMVEGLPVLGYVHWSLLDNYEWVAGYKSHLGLFAVDRTTFARTAKPSAGVLGAIARANGL

SEQ ID NO: 10338 - protein, 512 aa, Oryza sativa
MGLCSSSSARRDAGTPGGGNGAGNKDNAGRKGIVACGKRTDFGYDKDFEARYALGKLLGHGQFGYTFAAVDRRSSERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSTKEDSSLKATDFGLSDFIRPGKHFRDIVGSAYYVAPEVLKRKSGPESDVWSIGVITYILLCGRRPFWDKTEDGIFKEVLKNKPDFRRKPWPNITPCAKDFVQKLLVKDPRARLTAAQALSHEWVREGGQASDIPLDISVLHNMRQFVKYSRFKQFALRALASTLNAEELSDLRDQFNAIDVDKNGTISLEELKQALAKDVPWRLKGPRVLEIVEAIDSNTDGLVDFEEFVAATLHVHQLVEHDTEKWKSLSQAAFDKFDVDGDGYITSDELRMQTGLKGSIDPLLEEADIDRDGKISLDEFRRLLKTASMSSRNVQTPRSVHRS

SEQ ID NO: 10339 - protein, 392 aa, uncultured bacterium pCosFS1
MSVTDSDLEFDQRHIWHPYTSMSHPLPCYPVEAASGVELQLADGRRLIDGMSSWWAAIHGYNHPQLNLAATQQLEKMSHVMFGGITHPAANELCRKVVAMTPEALQCVFLADSGSVAVEVSLKMALQYWQARGERRQRILTLRHGYHGDTFGAMSVCDPDNSMHSLYQGYLAPHLFATAPQCGFDQAWDENDIAPFAALLEQHAGEVAAVILEPVVQGAGGMRIYHPTYLERVRELCDRYQVLLIADEIATGFGRTGKLFACEHAEVVPDILCLGKALTGGYMTLSATLTTRHVAETISNGAAGCFMHGPTFMGNPLACAVANASLSLLAENRWQQQVAAIETQLKQQLLPLKMQPKVADVRVLGAIGVVEMREPVDMAQLQRGFVERGVWI

SEQ ID NO: 10340 - protein, 429 aa, uncultured bacterium pCosHE2
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLKCVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 10341 - protein, 1228 aa, Agrobacterium tumefaciens
MADGASKADVNPQQTVNGIFQNFAPPVREQSPLRKAITAAYRRPEEECLAPLIDAATVTPEQAAAIRTTATKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGDQFVTGETIGEAIKRSKPLEEQGFQYSYDMLGEAATTAKDAERYYKDYENAIHAIGKASAGRGIYGGPGISIKLSALHPRYARVQAERVMAELLPRVKSLMLLSKKYDIGLNIDAEEADRLELSLDLLEELALDKDLAGWNGLGFVVQAYGRRCPFVLDYIIDLAQRAGRRIMVRLVKGAYWDAEIKRAQVDGLEDFPVFTRKVHTDVSYIACARKLLAARDVVFPQFATHNAQSMATIYHLAGPDFKLGDYEFQCLHGMGEPLYSEVVGKKKLDRPCRFYAPVGTHETLLAYLVRRLLENGANSSFVNRIADPAVPVASLLEDPVTVVKAYPVPGARHDRIAAPAGLFGPERANSAGLDLSNETALAALDNVLKAGATTEWKAAAPHAGGKTRPVLNPGDHNDVVGYVTEPTEADVEAAMQRAAASNWSSTPVEERAACLERAADRMQAEMPALLGLIMREAGKSMPNAIAEVREAIDFLRYYAAEARKTFKANETPLGPVVCISPWNFPLAIFIGQVTAALVAGNPVLAKPAEETPLIAAQGVRLLHEAGVPQDAVQLLPGDGKTGAALVGSALTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDSLSVDVGPVITAEAKGIIEKHVDSMRALGHRIEQISLAGETGKGTFVPPTIIEMKSLADLKKEVFGPVLHVIRFKRDNLDRLIDEINATGYGLTFGLHTRLDDTIQHVLSRVAAGNLYVNRNIIGAVVGVQPFGGRGLSGTGPKAGGPLYLGRVTQTAPKIDRVASQQDQAAVDLARWLDENGQSVAAEAARQAAALSGLGFETELAGPVGERNVYALHPRGKVLLIPATEQGLYRQLAAALATGNSVVIDNASGLEKSIYGLPATVTSRITWADSWEKSAPFAGALIEGDAERVVAINKKIPALPGPLVLVQAATTEALDRETQPYNLDWLVEEVSVSVNTTAAGGNASLMSIG

SEQ ID NO: 10342 - protein, 240 aa, Schizosaccharomyces pombe
MVGTSSLDISMSGSSSSDAEQWEKQTKSVHIDNSDVNSLILDYLVIQGDEEAAKTFAEEAQITDYYIPPYVKERLEICELIKSGSINSAICKLNELEPEILDTNSELLFELLRLRLLELIREVVEEKDTSDLAVERCLNFAHENLAPLAPSNQKFLNSLELTMSLLCFPPSSYSPALKNVLNYSQRERVANLANVSILKSQGLSNESRLLSLVNFERWCEKEAQRNSIEVQKFVPKASIK

SEQ ID NO: 10343 - protein, 402 aa, Pseudomonas putida
MGEDISKIVIIGAGQAGATVAFGLRRNGFAGEITLVGEESHLPYERPQLSKEMLRPEASAHKSIKTRADYEEQSILLELGCKVVRADAQAHSIVLDDGRQLAFDRLVIATGVQPRRLSSAFQGAHRVHYLRTLEDAARLRADLEAGKSLAIVGGGVIGLEVAAAARALNCPVTLIEAADRLMSRSVDEVVSAYLDRAHRRNGVDIRYGVAATELLDDGRLRLSDGGTVPAEAVLVGIGVTPNIEGFEHLDITDATGVRVDAYSQTVVPGIFATGDIASQPNGGGFGRIETWANAQDHALNLVKNLMGEAVPYEAPVWFWSDQGPINLQVVGDAANGRRIVRGDEHGDVFSVFRLDANQQVIGCATVNSPKDMAVARRWVKQRSSVDPQRLADPTIPLRDCAV

SEQ ID NO: 10344 - protein, 263 aa, Lolium perenne
MASSSSVLLVVALFAVFLGSAHGIAKVPPGPNITAEYGDKWLDAKSTWYGKPTGAGPKDNGGACGYKNVDKAPFNGMTGCGNTPIFKDGRGCGSCFEIKCTKPESCSGEAVTVTITDDNEEPIAPYHFDLSGHAFGSMAKKGEEQNVRSAGELELQFRRVKCKYPDDTKPTFHVEKASNPNYLAILVKYVDGDGDVVAVDIKEKGKDKWIELKESWGAVWRIDTPDKLTGPFTVRYTTEGGTKSEFEDVIPEGWKADTSYSAK

SEQ ID NO: 10345 - protein, 429 aa, Bradyrhizobium sp. WM9
MVGVHGPRRMKAIETLESNVRSYSRSFPAVFGRARGSIMFAEGDRKVIDFLSGAGALNYGHNNREIKAAISEYLESDGVVHGLDMATPAKVEFMEHFSSVILRERNLSYRFQFTGPTGANAVEAALKLSRKITGRHNVISFTNGYHGQSLGAIAASGNRFYRKASSIPLSGTTFMPYDGYLGSADSPADYVRKVLMDESSGIDLPAAILVETVQGEGGINVAGKEWLQSIQALAKEVGAIFIVDDIQMGCGRTGEFFSFEFAALSPDIVVMSKSLSGYGLPLSMLLIKEAIDAWEPGEHTGTFRGNNLALVSGKAALTLYWRNQTFSQQVQRLGAFMRGRLDAIAHQHGNKFAVRGRGMVCGFDCKTTEIAEVTAHKAFEKGLIIERCGPTDQVVKFLPALTIDQETLGRGLDIFEESLTETLNSARGS

SEQ ID NO: 10346 - protein, 383 aa, Spinacia oleracea
MASLVNNAYAALRTSKLELREVKNLANFRVGPPSSLSCNNFKKVSSSPITCKAVSLSPPSTIEGLNIAEDVSQLIGKTPMVYLNNVSKGSVANIAAKLESMEPCCSVKDRIGYSMIDDAEQKGVITPGKTTLVEPTSGNTGIGLAFIAAARGYKITLTMPASMSMERRVILKAFGAELVLTDPAKGMKGAVEKAEEILKKTPDSYMLQQFDNPANPKIHYETTGPEIWEDTKGKVDIFVAGIGTGGTISGVGRYLKERNPGVQVIGIEPTESNILSGGKPGPHKIQGLGAGFVPSNLDLGVMDEVIEVSSEEAVEMAKQLAMKEGLLVGISSGAAAAAAVRIGKRPENAGKLIAVVFPSFGERYLSSILFQSIREECENMKPE

SEQ ID NO: 10347 - protein, 478 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 10348 - protein, 477 aa, Dasyphyllum dicanthoides
  misc_feature (152)..(152): Xaa can be any naturally occurring amino acid
MSPQTETKASVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPXHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNRPGAVANRVALEACVQARNEGRDLANEGNEIIREASKWSPELAAACEVWKEIKFEFAAMDTLDP

SEQ ID NO: 10349 - protein, 439 aa, Selenomonas ruminantium subsp. ruminantium
MLNLTKSAAAFAEAKELMPGGVNSPVRSYKSVDCNPPFIDHALGDKIYDIDGNEYIDYVGSWGPMVVGHAHPKVVKALQEAATRGTSYGAPTCIESELAKLVMEVYPSIETIRMVNSGTEATMSALRLARGYTGREKIVKFIGCYHGHSDSLLVNAGSGMATFGVPSSPGVTKGTAQDTISVPYNDEEAITKVMEEVGDEVAAVIVEPVAGNMGLVLPKQGYVRKLRDLTEKHGALLIFDEVMCGFRASLGGAQAAYGITPDLTCLGKIIGGGLPVAAYGGRKDIMAKVSPSGPVYQAGTLSGNPLAMTAGLATLQIITAEPEDGKADYSRELTLKTKKLLLGWQEKAKAAGVAIQVHQAGSMFGIFFSEKDVLNYEDSCNADQEKFKVWFKSMLEQGVYLAPSQFETLFMSGAHTDEDIDRTIAAAEKAFAAVAAMEK

SEQ ID NO: 10350 - protein, 206 aa, Brassica oleracea
GYMVSSCGSCETCTDDQENYCPKMILTSGGKYYDDTITYGGYSDHMVCEEDYIIRIPENLPLDATAPLLCAGTTVYSPMKYHGLDKPGMHIGVVGLGGLGHVAVKFAKAMGIKVTVISTSDRKRDEALTRLGADLFLVSRDPEQMKDAMGTMDGIIDTVSATHPVLPILNLLKYKGKLIMVGAPDKPLELPVLPLIFGKKMVVGSM

SEQ ID NO: 10351 - protein, 203 aa, Brassica rapa
TLSSCRSCDTCTDYQKNHCPQMIMTSGGKYYDDTMTYGGYSDHLVCEEDYIIRIPENLPLDAAAPLLCAGVTVYSPLKYHGLDKPGIHIGVVGQGGLGHVAVKFAKAMGTKVTVISSSESKRDEAINRLGADLFLVSRDPEEMKDAMGTMDGIIDTVSATHPLLPLLGLLKYKGKLIMVGAPDKPLDLPALPLILGKKMVVGS

SEQ ID NO: 10352 - protein, 204 aa, Brassica rapa
  misc_feature (16)..(16): Xaa can be any naturally occurring amino acid
  misc_feature (45)..(45): Xaa can be any naturally occurring amino acid
  misc_feature (101)..(101): Xaa can be any naturally occurring amino acid
MASSCGSCETCIDDQXNYCPKMILTSGGKYYDDTITYGGYSDHMXCEEDYIIRIPENLPLDATAPLLCVGTTVYSPMKYHGLDKPGMHIGVVGLGGLGHVXVKFAKAMGTKVTVISTSDRKRDEALTRLGADLFLVSRDPEQMKDAMGTMDGIIDTVSAPHPVLPILDLLKYKGKLIMVGAPDKPLELPVLPLIFGKKMVVGSM

SEQ ID NO: 10353 - protein, 186 aa, Coccidioides posadasii
PEEEKFAYVEEIISLLELENLADAIIGDPETGLSVEERKRVTIGVELAAKPQLLLFLDEPTSGLDSQSAFNIVRFLRKLAAAGQAILCTIHQPNSALFENFDRLLLLQRGGECVYFGDIGTDARVLRDYFHRNGADCPSNANPAEWMLDAIGAGQTPRIGSRDWGDAWKTSPEFEQVKQRIVEIKD

SEQ ID NO: 10354 - protein, 355 aa, Glomerella cingulata
MSRANPPNASGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 10355 - protein, 388 aa, Thauera aromatica
MSEKSYLEWPFFEDRHRKLEAELDSWATNNISEHHGELDSACRELVAKLGAAGWLRYCVGGTSYGGEHETIDTRSICLLRETLARHSGLADFAFGMQGLGSGAITLHGSDAQKREYLPRVASGQALAAFALSEPGSGSDVAAMACSARLDGEYYVLDGEKSWISNGGIADFYVVFARTGEAPGARGLSAFIVDADTPGLEIAERIEVIAPHPLARLRFTDCRVHKSAMLGTPGLGFKVAMQTLDIFRTSVAAAALGFSRRALDEALRRATTREMFQQKLADFQITQVKLAQMATSVDISALLTYRAAWRRDQGHKVTREAAMAKMTATESAQQVIDSAVQIWGGCGVVSNHPVELLYREIRALRIYEGATEVQQLIIARQTLTAYEDS

SEQ ID NO: 10356 - protein, 333 aa, Oryza sativa (indica cultivar-group)
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTEALNAYLNKYHIELDPQLEALVGRHSRKPWSKFINADNQHLVSPEAVDFLDKLLRYDHQDRLTAREAMAHPYFLQVRAAENSRARPQ

SEQ ID NO: 10357 - protein, 474 aa, Pseudomonas aeruginosa
MQTKLLINGALVAGEGESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVMRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 10358 - protein, 433 aa, Azospirillum brasilense
  misc_feature (380)..(380): Xaa can be any naturally occurring amino acid
  misc_feature (431)..(433): Xaa can be any naturally occurring amino acid
MSDISNVFDLIKEHDVKYVDFRFTDPRGKLHHTVQHVSTIDEDVFEDGIMFDGSSIAGWKAINESDMILQLDPTTAVMDPFSAQPTLNILCDVYEPSTGQPHARCPRGIAKAAEKHMASAGIGDTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGXDGIQNKIHPGEAMDKNLYDLPAEELAKVPTVCGSLREALDSLKADSAFLQXXX

SEQ ID NO: 10359 - protein, 369 aa, Oryza sativa (indica cultivar-group)
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNFRY

SEQ ID NO: 10360 - protein, 493 aa, Oryza sativa (indica cultivar-group)
MDASAGGGGNSLPTAGADGAKRRVCHFYDAEVGNYYCGQGHPMKPHRIRMTHALLAHYGLLDQMQVLKPHPARDRDLCRFHADDYVAFLRSVTPETQQDQIRALKRFNVGEDCPVFDGLYSFCQTYAGGSVGGAVKLNHGHDIAINWAGGLHHAKKCEASGFCYVNDIVLAILELLKYHQRVLYVDIDIHHGDGVEEAFYTTDRVMTVSFHKFGDYFPGTGDIRDIGYSEGKYYCLNVPLDDGIDDDSYQSIFKPIISKVMEMYRPGAVVLQCGADSLSGDRLGCFNLSGKGHAECVKFMRSFNVPLLLLGGGGYAIRNVARCWCYETGVALGHELTDKMPPNEYFEYFGPEYSLFVAASNMENRNTNKQLEEIKCNILDNLSKLQHAPSVQFEERIPETKLPEPDEDQEDPDERHDPDSDMVLDDHKPMGHSARSLIRNIEVKREITESEAKDQHGKRLTTEHKGPEPMADDPGSSKQAPVSRRLLYPSANP

SEQ ID NO: 10361 - protein, 371 aa, Neurospora crassa
MVKETKLYDLLGISPTATQDEIKKAYRKAALKWHPDKNKDNPEAAEKFKECSQAYEILSDPEKRKMYDQFGLEFILRGGPPPTEGGANPFAGAGGMPEGFASFFGGGGMPGGGGGARTFSYGFNFTNPEDLFRDAFRDEKMGGGMGGGMGGGMGGMGFEDILFNAARGGAGQRRTARNPFGGADNMRSARQATPEVTTVERPLPVSLEDLFHGTTKKMKIKRKTFDETGKRTTSDTVLEVPIKPGLKKGSKIRFKGVGDQEEGGQQDLVFVVEEKPHPLFTRDGNDLIHTIDLDLKEALTGWKRTITTIDGKSINIEKAGPTQPGSQDVYPGLGMPISKQPGQRGNLIVKYNVKFPTSLTPEQKEKLKEIL

SEQ ID NO: 10362 - protein, 477 aa, Neurospora crassa
MGSQERRFNVKKIAIVGAGPAGLAAAKYLIAQKVFEDIVIFERQDEVGGAWYYSREPTHTLHVPQVSAFCPPDPPLHPEGKPPVFPSPMYEVLHTNIPRHLMQFSDKPFPEDSLIFPSRELVHEYLVEYAKDMRHLVRFSTLVQDVRLRRDSDGRDQWDVDALALETGEVTTTTYDAVVVASGHYYTTYLPDVKNIADFHKAHPDVITHSKLYRTPEPFSNKKVIVVGNSASGIDVAAQISRVSQQPLLLSVHSATPPAHLEWIRAEEVPAIEEFLVEERGVRFADGRVEKGVDAIVYATGYLFTFPFLKSLQPPLVTDGRRVYDLYKDLIHIDHPTLVFPGLPIKVVPFPFTESQAAIFSRTWANLLPLPSVEEMKKWEDDEAKKRGHAFHVWPKLGDANFINEVHDWIKKSGTEGKEPPCWNGELIWQRGIFMEAKLQFEIDGQKAKSLEELGFRYEPEDKELASKKTTPTETLL

SEQ ID NO: 10363 - protein, 404 aa, Pasteurella multocida subsp. multocida str. Pm70
MAHFPKSDKLEHVCYDIRGPVHKEALRLEEEGHKILKLNIGNPAPFGFEAPDEILVDVIRNLPTAQGYCDSKGLYSARKAIVQYYQSKGIHGATVNDVYIGNGVSELITMSLQALLNDGDEVLIPMPDYPLWTAAATLAGGKPVHYLCDEEANWFPDVNDIKSKITKRTKAIVVINPNNPTGAVYSQDLLLEIIEVARQHKLIIFADEIYDKILYDDAVHHHIAALAPDILTVTFNGLSKAYRVAGFRQGWMILNGPKKAAAGYIEGLDMLASMRLCANVPMQHAIQTALGGYQSINEFILPGGRLLEQRNKAYELINQIPGVSCIKPQGAMYMFPKIDIKKFNIYDDEKMVFDLLAQEKVLLVHGRGFNWHSPDHFRIVTLPHVHQIEEALTKLARFLAHYHQ

SEQ ID NO: 10364 - protein, 179 aa, Pasteurella multocida subsp. multocida str. Pm70
MKKHHVGILISEQDVRARIQTLGREITQYYQQKAVEKVIVVGLLRGSFMFMADLVRELNLPVEIEFMTTSSYGSGMTTNHDVKISKDLDGDIKGEHVLIIEDIIDTGYTLQKVREILKLREPASLRICTLLDKPSRREVEVPVEWVGFSIPDEFVVGYGIDYAQRYRNLGYIGHVVLEE

SEQ ID NO: 10365 - protein, 387 aa, Pasteurella multocida subsp. multocida str. Pm70
MSLDLSEIRQQITQLDRNLLKLLSERHRLAFDVARSKEITQKPLRDLEREQQLLQELIQFAENQNYQLEAQYITDIFQRIIEDSVATQQVYLQKKLNAQREQNIHIAFLGKRGSYSHLAARSYATRYQETFVELSCRSFDEIFEKVSAGEADYGVLPLENTTSGAINEVYDLLQHTDLSLVGELAYPIRHCVLVNGQDDLNQIETLYSHPQVIQQCSQFIKGLERVHIEYCESSSHAMQLVASLNKPNIAALGNADGGALYGLTVLKSDIANQPNNITRFIVVAKKPLQVSPQIHTKTLLLMTTSQQAGALVDALFVFKKHQINMTKLESRPIYGKPWEEMFYLEIEANIHNPETQQALDELKQYSHYLKVLGCYPSEIIKPVELTP

SEQ ID NO: 10366 - protein, 264 aa, Pasteurella multocida subsp. multocida str. Pm70
MNNPLIEVKHLTFKRGERTIYDNLNLRVEKGKITAIMGPSGIGKTTLLKLIGGQLQPEKGEIWFDGKDICQLSNAELYQVRQKMGMLFQSGALFTDISTFDNVAFPIREHTRLPESLIRKIVLMKLESVGLRGAAELMPSELSGGMARRAALARAIALDPELIMFDEPFAGQDPISMGVILSLIKRLNEALNLTSIVVSHDVQEVLSIADYAYIIADKRVIAEGTSTQLLQSQDPQVRQFLDGEADGPVRFHFPAEDYVEALFK

SEQ ID NO: 10367 - protein, 459 aa, Pasteurella multocida subsp. multocida str. Pm70
MAKAPKTAYVCNDCGAEFSRWQGQCAACKAWNTISEVRLVSSSNSAKGDRFSGYAGETRAKIQTLAEISLQETPRFSSGFHELDRVLGGGVVPGSAILIGGHPGAGKSTLLLQVMCGLAQNMTALYVTGEESLQQVAMRAKRLGLPTDKLNMLSETSVEQICQLADQLKPQIIVIDSIQVMHLADIQSSPGSVAQVRECASFLTRYAKTRQVAIIMVGHVTKDGTLAGPKVLEHCIDCSILLEGEADSRYRTLRSHKNRFGAVNELGVFGMTEQGLREVKNPSAIFLSRGEEQTPGSSVMVIWEGTRPLLVEIQALVDHSMLANPRRVAVGLEQNRLALLLAVLHRHGGLQMSDQDVFVNVVGGVKVTETSADLALLLALISSFRNRPLPQDLVVFGEVGLAGEIRPVPSGQERIGEAAKHGFKRAIVPFANRPKSAVPNMDVFTVKKLSDALAILENF

SEQ ID NO: 10368 - protein, 214 aa, Pasteurella multocida subsp. multocida str. Pm70
MKIILLGAPGAGKGTQAQFIMNKFGIPQISTGDMLRGAIKAGTDLGKQAKTLMDAGQLVPDDLIISLVKERVAQADCAKGFLLDGFPRTIPQADALKTVGIQIDYVLEFDVPDEVIVERMSGRRVHQASGRTYHVVYNPPKVEGKDDVTGEDLIIRADDKPETVLDRLKVYHSTTKPLVDYYQAEAKAGNTKYFRLDGTKKVEEVSQELDTILA

SEQ ID NO: 10369 - protein, 437 aa, Pasteurella multocida subsp. multocida str. Pm70
MSLEKHFEMTKRGSNVRQEVIAGLTTFLAMVYSVIVVPNMLGAAGFPAESVFIATCLVAGLGSLLIGLWANVPMAIGCAISLTAFTAFSLVLGQQVSIPVALGAVFLMGVVFTIISATGIRAWILRNLPSSIAHGAGIGIGLFLLLIAANGVGLVVSNQAGLPVKMGEFTSFPVLMSLIGLALIIGLEKMRVKGAILWVIIAITLVGLVFDPNVKFGGSIFKMPTFGENSLFLELDLMGALQPAILPVVFALVMTAVFDATGTIRAVAGQANLLDKEGQIINGGKALTSDSVSSIFSGIFGTAPAAVYIESAAGTAAGGKTGLTAVVVGVLFLLMLFFQPLAFLVPGYATAPALMYVGLLMLSNVSKLDFDDFIGAMSGLVCAVFIVLTANIVTGIMLGFAALVIGRVVSGEVKKLNVGTVLIAIALVAFYAFGWAI

SEQ ID NO: 10370 - protein, 398 aa, Pasteurella multocida subsp. multocida str. Pm70
MTQYNREIFDQVMIQNYVPAQFIPVRGKGSHVWDQQGKDYIDFTSGIAVNSLGHCADEIVDVLKQQSEKLWHSSNWFTSEPTLALATKLVEKTFAERVMFVNSGAEANEAALKLARRYAVDHFGYQKSKIIAFKQSFHGRTLFTVSVGGQAKYSDGFGPKPADIVHVPFNDLAAVQAVMDENTCAVIVEPIQGESGILPASQDFLQGLRELCDQHNALLIFDEVQTGVGRTGYLYAYMKYEVVPDILTSAKALGNGFPIGAMLTTHEIAKSFAPGVHGTTFGGNPLACAVAEKVIDIISAPPFLQKIQRTSEKFMQKLQEINQQCGLFKEIRGEGLLIGAELIEQYHGRASEFVKKAADNGLMILVAGPNVLRFAPALNISEEALALGFERLAKTLHI

SEQ ID NO: 10371 - protein, 195 aa, Pasteurella multocida subsp. multocida str. Pm70
MQVSRRKFFKICAGGMAGTSAAMLGFAPTEALAAPRNYKLLRAKETRNTCTYCAVGCGMLLYSLGDGSKNSKGKLFHIEGDPDHPVSRGALCPKGAGALDYVNSDRRVKYPEVREAGSKEWKRISWHEAIERIARHIKDDRDANFVEKNDAGEPVNRWMTAGFLAGSACSNETGILTQKFVRSLGIIFTDNQASI

SEQ ID NO: 10372 - protein, 427 aa, Pasteurella multocida subsp. multocida str. Pm70
MTTSLSLFQRAQHRIPGGVNSPVRAFKGVGGTPIFIEKAQGAYLYDTEGNQYIDYVGSWGPMILGHNHPTILDAVISTAQNGLSFGAPTALEIELAELVCSLVPSIDMVRMVSSGTEATMSAIRLARGYTKRDKIIKFEGCYHGHADSLLVKAGSGALTLGQPSSPGVPADFAKHTLTCTYNDLDSVKHAFEQYPNEIACLIVEPVAGNMNCIPPQEGFLQGLRALCDQYGAVFIIDEVMTGFRVALGGAQTYYGVTPDLTCLGKVIGGGMPVGAFGGKKAIMQHIAPLGPVYQAGTLSGNPIAMAAGLACLTELKKAGNAQRLAQQTEKLALGLKALADKHHVPFVVNYVGGMFGIFFTEQKTVSSYQAVMACDTEKFNRFFHAMLAQGIYLAPSAFEAGFMSLAHSDQDIERTLQAADQVFSQLA

SEQ ID NO: 10373 - protein, 424 aa, Pasteurella multocida subsp. multocida str. Pm70
MTEKKTTLKTEIIAGITTFFTMVYIVFVNPSILGDAGMDKQVVFVTTCLIAALGTIAMGLFSNLPIALAPAMGLNAFFAYVVVGKLGYSWQIGMGTIFWGSLGLLVLTIFQIRYWLMASIPLGLRVGIGAGIGLFIALIGFKNMGLVIANPVTLVALGHLHDPKVLLGILGFFIIVVLAARNIYSGVLVSIAVVTGLAFFIDPNVTFNGIMSMPPSLSPVVGKVDIAGALDTALLGIIFSFLLVNLFDSSGTLLGVTDKAGFSDERGRFPKMKQALYVDSVSAVAGSYMGTSAISTYIESGAGVSVGGRTGLTAITVGVLFLLTIFFSPLASVVPAYATAGALVYVGILMASSLIRVKWEDLTEATPAFITAAMMPFTYSITEGIAFGFISYCVMKACTGRVKEINAPVWVVSLLFLIKFIWVG

SEQ ID NO: 10374 - protein, 316 aa, Pasteurella multocida subsp. multocida str. Pm70
MLKIVFLDSTAIPKHIPIPRPSFPHQWVEYEHTTPDQVVERMQDVDIAVTSKVLFSREVMQQLPKLKLIAITATGTNNVDLVAAQELGITVKNVTGYSSTTVPEHVIGLIYALKHSIMSWYRDQLSAKWADCKQFCYFDYPITDVKGSTLGVVGRGCLGSEIGRLATALGMNVLYAEHKGAKTCREGYTPFEDVLAQADILTLHCPLTDTTQNLINQDTLALMKKGAFLINTGRGPLVDEQALVAALESGHLGGAAVDVLVKEPPEKNNSIIQAATRLPNLIVTPHIAWASDSAVTTLVNKVKQNIEDFVKNEQIA

SEQ ID NO: 10375 - protein, 268 aa, Pasteurella multocida subsp. multocida str. Pm70
MRRFDTLFSQLQQKQQGAFVPFVTLCDPNLAQSFEIIQTLVENGADALELGFPFSDPMLDGPVIQAANQRALVAGCSTDASFQLLTQVRSTYPTLPISLLLCANLVYAQGIERFYQRCAEVGVDAVLIADLPLFAHREFTVMAEKYSIQQVFICPPNACEDTIKRVAQQTQGYTYLVSRSGVTGVENQQSADNLKTLVERLKAYQAPPILQGFGISQPQQVSDVLKIGVNGAISGSATVQIIEKYHHDPQACLAELAQFTQKMKQATT

SEQ ID NO: 10376 - protein, 1198 aa, Pasteurella multocida subsp. multocida str. Pm70
MTYQLLPKLTSLREPLSQHYRIDETTLVQKLLSDAEIPSDLQTKIQQLARKLVENVRNARQNASGVDALMHEFSLSSQEGVALMCLAEALLRIPDKATADKLIRDKISKGNWRSHIGQSPSMFVNAAAWGLLITGKLVSTHSEQQLSSSLTKLIAKGGEPLIRKGVEVAMRLLGKQFVTGETIEQAIKNGEKRFQQGFRYSYDMLGEAALTEEDAARYYQDYVDSIHAVGQRSSGLGVYAASGVSIKLSAIHPRYSLSQHQRVIDELYPKVKQLFLLAKQYDIGLNIDAEEADRLDISLDLVDRLLADPDLAHFNGIGLVVQAYQKRCTFVIDYLIEQARKHQHKIMVRLVKGAYWDSEIKRAQTDGAEGYPVFTRKVHTDVSYIACAKKLLAAQDVIYPQFATHNAQSLATVYHLAQGKQFEFQCLHGMGETLYDQVVGKHNLNVQCRIYAPVGSYKTLLAYLVRRLLENGANSSFVNHIVDDSIPVEALILDPVQKAKETEGTMHPKTPLPRDLFAGKRVNSKGYDLTDALQLQQLQNALTELSQNEYEAYPLLENTTAPTGKPRLVFNPAKRAMLVGKVIDAREEDVEQAFENALRHKDNWANTPVEQRAVILEKMADLMEQHMPQLFDLAVREAGKTLNNAIAEVREAVDFCRYYAQEARKLGNENPPRGIVVAISPWNFPLAIFIGEVCSALVTGNVVIAKPAEQTSLMAHFAVKLFQQAGLPIGVLQCLCGAGKVIGEKLVSDARVDGVIFTGSTDTAKRINQNLAKHNKLIPLIAETGGQNAMIVDSSALAEQVVLDVLNSAFDSAGQRCSALRVLYVQHDVAPHILTMLKGAMAELKVGNPQHLTTDVGPVIDEMAQKRLLQHIETMRTVAKDCYQVPVDPEMQQQGIFVPPTLFELENLHHLKHEVFGPVLHVVRFHASEFNQVIAQINSTGFGLTSGIHSRIDESINHWLEQVHAGNLYVNRNTVGAVVGVQAFGGRGLSGTGPKAGGPFYLQRLVHAKHWALTPLHYNTPRDLSDLAAKVRSIFTKSEQAPLLSLIDQVAQCSPLNTTFRMQGITGEENYLTFTPRSLIAIGNGPLAQQMQALIAVAAVGATAVISKYSQLAAYEKRLADYLFVAEVEECEEISQLIVLDPITAKQKAQYADRPGAILTYVEQLDLALSLFPLLHEQAISINTTAAGGNASLMAEMD

SEQ ID NO: 10377 - protein, 464 aa, Pasteurella multocida subsp. multocida str. Pm70
MKFIDFSAYKVEAKKLLLIALPILLAQIAQNSMGLVDTIMSGRVSSADMAAISVGASIWFPLVLFGHGLLLALPPTISYLNGSGKRDQIAHQVRQGIWIILFSCLPLGILIYYSNLVFDYMQVEDHLKEITIGYLHAMIWGLPAYLLMINFRCLNDGIAKTKPAMVITFLGLGLNIPLNYIFIYGKLGIPAFGAVGCGIATAIVNWFMCILMIAYCKNARNQRDLKVFAKILEKPNFTTLKKLLNLGFPIAVALFCEVALFALTALLLSPLGTDIVASHQIALNTSSFLFMLPMSLGMAATILVGQRLGEGAADKAKQVSYSALIVGLLIAVITATLTVIFRVEIAEIFVKDRDVIAMAGTLLLIAALYQFSDTVQVVAGGALRGYKDTKAILYITLFCYWVVGMPMGYTLARTDLLMPALGAEGFWIGFVVSLTIAATLLMIRMRKIQAQPDAILFAKLEKLK

SEQ ID NO: 10378 - protein, 479 aa, Pasteurella multocida subsp. multocida str. Pm70
MSRRLRRTKIVCTMGPSTERGNNLEKIIMAGANVVRMNFSHGTPEDHIGRAEKVREVAKKLGKTVAILGDLQGPKIRVSTFKDGKIFLNIGDKFVLDADLPKGEGTQEGVGLDYKTLPQDVVPGDILLLDDGRVQLKVLSTEGNKVFTEVTVGGPLSNNKGINKLGGGLSADALTEKDKNDILLAAKIGVDYLAVSFPRSSADLNYARELAEAAGLKAKIVAKVERAETVATTEAMDDIILASDVIMVARGDLGVEIGDPELVGVQKKLIRRARQLNRVVITATQMMESMISNPMPTRAEVMDVANAVLDGTDAVMLSAETAAGQYPAETVATMAKVCLGAEKMPSINVSRHRMDITFDSIEESVAMSAMYAANHMKGVAAIIAMTHTGRTALLMSRISSGLPIFALSRNQDALNLCALYRGVTPVHFDEVSRNSKGAAAAIRLLKEKGFLVSGDLVLLTQGDELLASGTNTCRTLVVE

SEQ ID NO: 10379 - protein, 422 aa, Pasteurella multocida subsp. multocida str. Pm70
MEFATKCLHAGYTPKNGEPRVQPIVQSTTFTYDSAEEIGKLFDLQAAGYFYTRLSNPTTNAAEEKITALEGGVATMCTASGQAAVFYAMLNILQAGDHFISSSYVYGGSYNLFAHTFKKMGIEVTFVDQDLPLEELKKAIRPNTKAIFAETIANPALRVLDIEKFVALAKAAQAPLLVDNTFATPYFCRPIEFGANVVIHSTSKYLDGHAIALGGSITDGGNFDWNNGKFPQLSTPDQTYHGLVYTETFVPAAYIVKARVQLMRDLGATPAPQNSFLLNVGMETLALRMQRHYENAQAVAEFLENHPQVAKVSYPGLASSPDHALKQKYLPNGLCGVISFEIRGGRETAAKWLNALQLASREVHVADIRTCALHPATSTHRQLSEAELEKVGISAGLIRLSCGIESIQDILADLEQAFHAAK

SEQ ID NO: 10380 - protein, 372 aa, Pasteurella multocida subsp. multocida str. Pm70
MAKKDYYDVLGVERGADEKEIKRAYKKLAMKYHPDRTQGNKELEEKFKEIQEAYEVLSDKQKRANYDQYGHAAFEQGGFGGGGFSGADFGDIFGDMFGDIFGGGRARQRVVRGDDLRYDLEISLEEAVRGTTKDIQINTLAHCDSCDGSGAEKGSKVETCSTCHGAGRVRRQQGFFVTEQVCPSCHGSGKKIEKPCKSCHGDGRVHKKKNLSVKIPAGVDTGNQLRLSGEGAAGENGAPNGDLYVVIHVRDHHIFERDGSNLYCEVPISFTMAALGGEIEVPTLDGRVKLKIPAETQTGKLFRMRGKGVTSARSAYAGDLICKIIVETPVKLNEEQKALLRQLEESLEGSSNKPKSSSFFDGVKKFFDNLGK

SEQ ID NO: 10381 - protein, 398 aa, Pasteurella multocida subsp. multocida str. Pm70
MSEKQTLSTQFIHTGRRKPFLQGGVNPVIQRASSLVFDSLAHKKQATIGRAQGELFYGRRGTLTHFALQEAMAELEGGEGCYLYPCGAAAVTQSILSFVQSGDHILMTGAAYEPTQEFCNCVLKKMQIDTTYYDPMIGEGIAELVQENTKVLFLEAPSSLTMEVSDIPAIVKAARRVNPDIVIMIDNTWSAGVFFKALEQGIDISIQAGTKYLVGHSDVMIGTAVANKRCWAQLREHSYLMGQMVDAESAYMTARGIRTLGIRLKQHEENALKVAHWLAAQPEVKAVYHPALESCPGHQFFKRDFSGATGLFSFELNQRLNPQQLARFMDHFTLFSMAYSWGGFESLILHYQPEEIMAMRPNITRQLNGTLIRVHIGLEDPVDLIADLEAGFARLNAM

SEQ ID NO: 10382 - protein, 405 aa, Pasteurella multocida subsp. multocida str. Pm70
MNDNVNKDGWKALLGSAVGYAMDGFDLLILGFMLSAISADLALTPAQSGSLVTWTLIGAVAGGIIFGALSDKYGRVRVLTWTIVLFAVFTGLCAFAQGYWDLLIYRTIAGIGLGGEFGIGMALAAEAWPARHRAKASSYVALGWQVGVLGAALLTPLLLPHIGWRGMFLVGIFPAFVAWYLRAKLHEPEIFVKKQTALERQKTSRLEPFRLLIKDKATAKISAGIVVLTSVQNFGYYGIMIWMPNFLSKQLGFSLTKSGVWTAVTICGMMFGIWLFGQLADRIGRKPSFLLFQFGAVISIFTYSQMSDPTYMLFAGAVLGMFVNGMMGGYGALMSEAYPTQARATAQNVLFNLGRAVGGFGPIVVGALVSTYSFQLAIAFLASIYIIDMIATIFLIPELKGKQLD

SEQ ID NO: 10383 - protein, 472 aa, Pasteurella multocida subsp. multocida str. Pm70
MNKEIKTQVVVLGAGPAGYSAAFRCADLGLETVIVERYSTLGGVCLNVGCIPSKALLHVAKVIEEAKALAEHGIVFGEPSTDVNKIRGWKEKVINQLTGGLAGMAKQRKVQVVNGYGKFSGPNTIIVAGEEGETTIKFDHAIIAAGSRPIQLPFIPHEDPRIWDSTDALKLKEVPENLLIMGGGIIGLEMGTVYHALGSKIDVVEMFDQVIPAADKDMVQIYTKRVAKKFNLLLETKVTAVEAKEDGIYVSMEGKASETRRYDAVLVAIGRVPNGKLIDAGVAGVEVDDRGFIRTDKQMRTNVPHIFAIGDIVGQPMLAHKGVHEGHVAAEVIAGMKHYFDPKVIPSIAYTEPEVAWVGKTEKECKAEGIAYEVAKFPWAASGRAIASDCADGMTKLIFDKNTHRVIGGAIVGTNGGELLGEIGLAIEMGCDAEDLALTIHAHPTLHESVGLAAEVFEGSITDLPNPKAKKK

SEQ ID NO: 10384 - protein, 183 aa, Pasteurella multocida subsp. multocida str. Pm70
MLRIITALLLAGVVCVAQAKNVVLHTNYGDIKMVLEEEKAPISTQNFLRYSQAGFYNGTIFHRVIPGFMIQAGGFEVGMKQKKTDAPITNEANNGLKNLRGTVAMARTSDPHSATAQFFINTVDNDFLNFSAETQKGWGYAVFANVVAGMDVVDRISQVDTERSGFHRDVPKAPVIIKSVTIE

SEQ ID NO: 10385 - protein, 349 aa, Pasteurella multocida subsp. multocida str. Pm70
MSNNDFLVLKNVTKAFGKAVVIDNLDLSIKRGTMVTLLGPSGCGKTTVLRLVAGLESPTSGQIFIDGEDVTKSSIQNRDICIVFQSYALFPHMSIGDNVGYGLKMQGVSKEERAKRVKEALELVDLAGFEDRYVDQISGGQQQRVALARALVLKPKVLLFDEPLSNLDANLRRSMREKIRELQQRLGITSLYVTHDQTEAFAVSDEVIVMHKGKIMQKAPAKELYLRPNSLFLANFMGESSIFQGTLQQDQVTVNGYQFKLNNAAQFGLTDGACLVGIRPEAISFKETGEAAQRCSIKSAVYMGNHWEIVANWGGQDLLVNTNPEQFNPELKEAYVHLAEHGVFLLKPE

SEQ ID NO: 10386 - protein, 369 aa, Pasteurella multocida subsp. multocida str. Pm70
MTQHYSIETLLAQAGNRTDERTGAVSTPIFLSTAYAHHGIGESTGYDYTRTKNPTRSVLEETIAKLEGGERGFACASGMAAIQLIMSLFTSPDEWIVSRDVYGGTYRLLDFAYKNTQGVKPVYVNTSEVSCIEAAITSNTKAIFVETPSNPLMEECDVAAIAKIAKKHNLLLIVDNTFLTPVLFRPIEAGADIVIHSGTKYLAGHNDALVGLVVAKGEELCQRLFYIQNGAGAVLSPFDSWLTIRGMKTLALRMERHEQNAKQLAAFLASQPQVKNVLYPNKGGMLSFRLHEAHWVNPFLKALKLITFAESLGGTESFITYPATQTHMDIPEEERIARGVCNCLLRFSVGLENVEDIKADLLQAFAQLN

SEQ ID NO: 10387 - protein, 166 aa, Pasteurella multocida subsp. multocida str. Pm70
MYIDTSELCDIYLDQVDVVEPIFSSFGGVNRFYGKVTTVKCFENNGLITDILEENGEGRVLLIDGGGAVRRALVDAELAQLAVDNGWEGIIVYGAVRQIQQLEEMDIGIHALAPIPVGADKQNIGEIDVPVNFGGVTFFPEDYVYADLTGIILSQEPLELDEFNDA

SEQ ID NO: 10388 - protein, 472 aa, Pasteurella multocida subsp. multocida str. Pm70
MSDTTAIANVFKLIEEYDIKFVLLRFTDIKGKEHGVSLPVNLVDEDLFEDGKMFDGSSVEGWKAINKADMLLMPMPETAVVDPFAQIPTLSLRCSIYEPSTMQSYDRDPRSIAIRAENYMRSTGIADEALFGPEPEFFLFDDVRFDVSMNRSSYSVDDIEAAWNTNKKYEDGNNAYRPLKKGGYCAVAPIDSAHDIRSEMCLILEEMGLVIEAHHHEVATAGQNEIATRFNTLTTKADETQIYKYVVQNVAYEHGKTACFMPKPITGDNGSGMHCNMSLSKDGKNVFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGIINKIHPGDAMDKNLYDLPPEELQNIPAVASSLEEALNALEQDYEFLTKGNVFTQAFIDAFITIKRKEVERLNMTPHPVEFEMYYA

SEQ ID NO: 10389 - protein, 201 aa, Pasteurella multocida subsp. multocida str. Pm70
MKINWQKVDNLLPVIIQNVATCEVLMLGYMNQEALEKTLAEKRVTFFSRTKNRLWTKGETSGHFLNVVDMSLDCDNDTLLILVNPIGETCHTGAESCFYQFEKTTQPDWIFLSKLERLIASRKGADPESSYTAQLYAKGTKRIAQKVGEEGVETALAATVKDKAETICEAADLVYHLTVLLQDADLSWSDVIHKLKERHTK

SEQ ID NO: 10390 - protein, 451 aa, Pasteurella multocida subsp. multocida str. Pm70
MTKHYDYLAIGGGSGGIASINRAASYGKKCAIIEAKALGGTCVNVGCVPKKVMWYGAQIAEAIHQYAPDYGFDLQVNKFDFAKLVESRQAYISRIHTSYHNVLAKNNVDVIQGFAKFVNANTVEVNGEHITADHILIATGGRPSHPAIPGAEYGIDSDGVFALSELPKRVAVVGAGYIAVELAGVMNSFGVKTHLFVRQHAPLRHFDPLIVDTLLEVIQQDGIQLHTQAIPQEVVKNADGSLTIKLEDGRSQEVDCLIWAIGRHPATDTINLEASGVETNARGFVKVDKYQNTNVEGIYAVGDIIEGGIELTPVAVAAGRRLSERLFNNKPNEHLDYNLVPTVVFSHPPIGTIGLTEPKAIEQYGEENVKVYKSSFTPMYSAVTQHRQPCRMKLVCVGKEEKIVGLHGIGFGVDEMIQGFAVAIKMGATKADFDNTVAIHPTGSEEFVTMR

SEQ ID NO: 10391 - protein, 229 aa, Pasteurella multocida subsp. multocida str. Pm70
MDKKQLIQQLKTQPISVGILASDWLKFADTLTTLSRHHLRLLHFDIGDGQFSPFFTVGALAVKQFPSPWLKDVHLMVNDPFHVAKACADAGADIITLQVEQTDCLAETISYLREHYPDLLIGLTLCPDTEIDLLTPYLAQVDLIQILTLDPRTGVKAETDAVIKRITRISNMLGEHRDQKLISVDGSMNLALASQLFPLGIDWVVSGSALFSQADVDATLSEWKTHLCR

SEQ ID NO: 10392 - protein, 261 aa, Pasteurella multocida subsp. multocida str. Pm70
MARRPLVMGNWKLNGSKAFTKALIEDLKTELAGVEGCDVAIAPPVMYLAEAEAALKCSCSCGGKAIALGAQNVDVNVQGAFTGDISTEMLKDFGAKYIIIGHSERRTYHKESDEFIAKKFAALKQAGLVPVLCIGESEAENEAGKTEEVCARQIDAVLNTLGAEAFNGAVIAYEPIWAIGTGKSATPAQAQAVHAFIRGHIAKKDNAVAEQVIIQYGGSVNDANAAELFTQPDIDGALVGGASLKAPAFAVIVKAAAKAKN

SEQ ID NO: 10393 - protein, 430 aa, Pasteurella multocida subsp. multocida str. Pm70
MMPIQNFSQIDRTYRYWRIHLMIAMYVGYAGFYLSRKSLNYAMPALISDLAMDKNAIGLMATLFYLTYGLSKFFSGLFSDQANPRYIMAIGLMMTGITNILFGLSSSVFLFTCLWVINAWFQGWGWPACSKYLTTWYSRSERGLWWSIWNTAHNVGGALIPLIVGYLTLHYSWRHGFIVAGIIVILISVFLLWRLPSTPDAMGLPSIGQWRHDPLELAQEKEGQDLPWRQILRDYVFYNKYLWLLAMSYALVYLVRTAINDWGNLYLSERYHYDLVSANSALSLFEIGGFMGSLVAGWGSDKLFSSNRGPMALVFAIGIFFSITALWLMPKENMLLQSGLFFCVGFFVFGPQMLIGMAAAECAHKKTAGTATGFVGLFAYLGAALAGYPLALITQTFHWTGFFVVISCCAFAIALLLLPFLKVQPNQSSC

SEQ ID NO: 10394 - protein, 459 aa, Pasteurella multocida subsp. multocida str. Pm70
MLSFLQEVRKPTLELPVEERRKLWFKPFMQSYLVVFIGYMAMYLIRKNFNIAQNDLIETYGLSKTQLGMIGLGFSITYGVGKTLVSYYADGKNTKQFVPFMLILSAICMLGFSASMGGGSVSLFLMIAFYALSGFFQSTGGPSSYSTITKWTPRNKRGTYLGFWNLSHNVGGAAAAAVALFGANVFFNGHVIGMFVFPSIIALIIGFWGLRYGSDSPEAYGLGKAEELFGEPLSEEDLATEQNQLTKWQTFVQYILKNKVIWLLCFANIFLYIVRIGIDQWSPVYAYQELGFSKDAAISGFALFEVGALVGTFLWGYLSDLANGRRGLTACVALILIVFTLEFYQFATNEVMYLCALFVLGFLVFGPQLLIGVAAVGFVPKKAISVADGVKGTFAYLIGDSFAKLGLGMIADGTAIFGLTGWAGTFAALNISAIVCMVLLAFVAIAEEKKIRKIKAQAR

SEQ ID NO: 10395 - protein, 238 aa, Pasteurella multocida subsp. multocida str. Pm70
MFKIQKLSLITLVVSAVISGNALANTDAKFNDEASYAVGVLLGSNVKQIVESQKGIIEYDNTRLLAGVQDVLNGKVDLDSNEQIAQTLQRVQEKMQQAQAQLLADIAKQAKQDGDQYRQTFEKKAGAKKTQSGLLYRIEQAGTGNTIKPTDTVTVNYTGKLPNGEVFDSSRGKPVSFKLNQVVPGWTEGLQLVKKGGKIELVLPPELAYGEQGAGQIPPNATLHFDVEVIDVKADTQK

SEQ ID NO: 10396 - protein, 306 aa, Pasteurella multocida subsp. multocida str. Pm70
MYNTLNNKEDISLVSNNFGFLRLPVHFNPVETDAEWVITGVPFDASVSGRAGTRFGAEAIRRASVNLAWEHCRFPWDFDVRERLKIVDCGDLVYSFGDNQNFVEELEAHATALLKAGKRCLTFGGDHFITLPLLRAHAKHFGKLAMIHFDAHTDTYENGSRYDHGTMFYHAPNEGLIDAAHSVQIGIRTEFDRNLPFTVLSAPQVNEESVAQTVAKIKEVIGDLPVYLTFDIDCLDPAYAPGTGTPVCGGLSTDRALKILRALKDVNIVGMDLVEVSPAYDQSDITALAGATLALEMLYMQGAKKG

SEQ ID NO: 10397 - protein, 481 aa, Pasteurella multocida subsp. multocida str. Pm70
MIGPFKPAPHIAELPADKIDARYRFLRWQVFAGIFFGYAAYYFVRANFDLAQKGLIEAGMYNKAELGIIGTGAGLAYGLSKFFMASISDRSNPKVFLPFGLLLSGLCMTMMGLMPWATSGIAVMFIMIFLNGWFQGMGWPPCGRTMVHWWSKSERGSIVSIWNTAHNLGGMVPGAMVLLASAVYFSTHGVEATAKDVWQQALYYPGIAAMIAAIPIYFMMKDTPQSCGLPPIEKWRNDYPDDYNEKTYEHDLSTKDIFVTYVLKNRLLWYIAIANVFVYLIRYGVLKWSPVYLGEVKHFNIKGTAWAYTIYELAAVPGTLLCGWVSDKVFKGKRGLTGFIFMILTTAAVVALWLNPATPEAELAKYAGHAWYENPYQLMDFILMTTIGFLIYGPVMLIGLHALELAPKKAAGTSAGFTGLFGYLGGTVSASAVVGWAAEYYGWDGGFYVMIAGGVLAILLMFITMIEESKHKARLEDHYGK

SEQ ID NO: 10398 - protein, 262 aa, Pasteurella multocida subsp. multocida str. Pm70
MDKSLKAACIGEFLGTALLIFFGVGCVAALKVAGANFGQWEISIMWGLGVAIAVYASAGLSGAHLNPAVTIALWQFACFDGKKVVPYILAQLAGAFCSAALVYFLYHNLFIDVEIAQQMVRGTPESLSLASTFSTYPHPSISVLHAFIVEFVITAVLMALILALTDDGNGLPRGPLAPLLIGFLIAIIGGAMGPLTGFAMNPARDLGPKVFASLAGWGEIALTGGREIPYIFIPVIAPILGGLFGGWIYTKFVGKNLPCHCE

SEQ ID NO: 10399 - protein, 227 aa, Pasteurella multocida subsp. multocida str. Pm70
MELVFIRHGFSEWNAKNLFTGWRDVNLTERGIEEAKSAGKKLLEAGFEFDIAFTSVLTRAIKTCNIVLEESNQLWIPQVKNWRLNERHYGALQGLDKKATAEQYGDEQVHIWRRSYDISPPDLDPQDPHSAHNDRRYAHLPSDVVPDAENLKITLERVLPFWEDQIAPALLAGKRVLVTAHGNSLRALAKHIEGISDADIMDLEIPTGQPLVYKLDDNLKVVEKYYL

SEQ ID NO: 10400 - protein, 486 aa, Pasteurella multocida subsp. multocida str. Pm70
MIKHWINGKEVASEETFDNFNPATGEVICQVASGGEKEINAAVQAAKDAFPKWSKTPAKERARLMRKLGELIDQNVAKLAELETLDTGLPIHQTKNVLIPRASHNFDFFAEVCTRMNGHSYPVDDKMLNYTLYQPVGVCGLVSPWNVPFMTATWKTAPCLALGNTAVLKMSELSPLTANELGRLALEAGIPEGVFNVVQGLGSTAGHALVTHDDVRAISFTGGTATGKHILKHAGLKKYSMELGGKSPVLIFDDADLDRALDAALFTIFSLNGERCTAGSRIFIQETVYDEFVKQFAARAKRLIVGDPQDFNTQVGSMITRQHYDKVTGYIRIGLEEGATLLAGGLERPQNLPAHLQKGHFIQPTVFADVDNRMRIAQEEIFGPVVCLMKFKDEAEALRLANDVEYGLASYIWTKDIAKALRLSNGIEAGMVFVNSQNVRDLRQPFGGIKASGIGREGGEYSFEVFAELKNVCISMHDHPIPRWGL

SEQ ID NO: 10401 - protein, 486 aa, Pasteurella multocida subsp. multocida str. Pm70
MGGISMQQFSLLKTKAYINGEYVQAKEHKTFAVTNPANQQIICELPDLSAEETEYAIACAAQAQKKWQKVTPKERANLLRRWYNLVIENQEELAQLLSLEQGKPINESRGEILYGASFIEWFAEEAKRIYGDVLPQDKENHRLLVIKQGIGVVAAITPWNFPNAMITRKAAPAFAAGCAMVLKPAQETPLSALALAELAHQAGLPAGLFNVITSTRSVEIGKVLTEHPTVRKVTFTGSTRVGKILMAQSASTVKKLSLELGGNAPSIVFDDADLENAIEGIIASKFRNSGQTCVCTNRIYVQAGIYDRFVELFSAKVAAFKVGSANEAGVNIGPLISQSAVNKIQEHIDDATAKGANLVIGGKLHTRGGTFFEPTVLRDVTQAMLVAKDETFAPLAPVFKFDTEAQVIEMANDTEFGLASYVYTQDISRIWRVSEALEYGIVGINEGLISNEMAPFGGVKESGLGREGSRYGIDEFLEIKYLCLKV

SEQ ID NO: 10402 - protein, 484 aa, Pasteurella multocida subsp. multocida str. Pm70
MSVKGDIGVIGLAVMGQNLILNMNDHGFKVVAFNRTTSKVDEFLQGAAKGTNIIGAYSLEDLANKLEKPRKVMLMVRAGEVVDQFIEALLPHLEEGDIIIDGGNTNYPDTNRRVAYLREKGIRFIGTGVSGGEEGARFGPSIMPGGDESAWEHVKPILQAISAKTDKGEACCDWVGRDGAGHFVKMVHNGIEYGDMQLICEAYQFLKEGVGLSDDELEATFKAWRNTELDSYLIDITADILGYKDEDGSRLVDKILDTAGQKGTGKWTGINALDFGIPLTLITESVFARCVSSFKEQRVQASRLFNKVVGKVEGDKAAWVEAVRKALLASKIISYAQGFMLIREASENFGWHINYGGTALLWREGCIIRSRFLGNIRDAYEANPDLIFLGSDAYFKGILENSLGEWRKVVAKSIEVGIPMPCMASAITFLDSYTSERLPANLLQAQRDYFGAHTYERTDKPRGEFFHTNWTGRGGDAASTTYDV

SEQ ID NO: 10403 - protein, 238 aa, Pasteurella multocida subsp. multocida str. Pm70
MQVFNLTTCLPVRSMMKPYLIAPSILSADLARLGEDVEQVLTCGADVIHFDVMDNHYVPNLTFGPAICQALRHYGITAPIDVHLMVKPVDRLIPDFAKAGANYITFHPEATEHIDRSLQLIRDCGCKSGLVFNPATPLSYLDYVMDKVDVILLMSVNPGFGGQSFIPSTLDKLREARQRIDESGFDIRLEVDGGVKVSNIADIARAGADMFVAGSAIFDQPDYQKVIDEMRQQLATVE

SEQ ID NO: 10404 - protein, 349 aa, Pasteurella multocida subsp. multocida str. Pm70
MEKKIYFGTNLKMYKGNCETVDYLTQLLALREKLQSDYDIELFVIPSYIALKDAVHAAASETTHKILIGAQNMNAKDKGQFTGEISPLMLKELGVQLVMIGHSERRHVLKETDQEENEKVLSALKHGFKTLLCVGETLEQKNYQISDEVLRTQLKIGLHGVSVKQLPHLFIAYEPVWAIGEGGIPATAQYADEKQKIIKQCLFEMFGEESKKIPVLYGGSVNLENANELIMQPHIDGLFVGRSAWDAQCFYTLIDGALKALAGTTHQFSPIATQLIKHLGGKENISALTHCASRIRVMTRNENHINKVAIEKINGVSGLFSIANQYQIIVGPKWVEKIYSEMKALLETE

SEQ ID NO: 10405 - protein, 410 aa, Pasteurella multocida subsp. multocida str. Pm70
MTTKVSLDKSKIKFLLLEGVHQTALEVLQNAGYTNIEYHKKALDDDELKEAIKDAHFVGIRSRTFLTEEVLAHAQKLIAIGCFCIGTNQVNLQAAKLRGIPVFNAPFSNTRSVAELVLGEILLLMRNVPQANAEVHRGIWNKSANGSHEVRGKKLGIIGYGHIGSQLSIIAESLGMRVFFYDIENKLPLGNAQQLRTLEELLSSCDVVSLHVPENASTKNLISAERIAQLKEGAILINAARGTVVDIDALAQALEAGKIRGAALDVFPEEPASIQEEFVSPLRAFDNVILTPHIGGSTSEAQENIGAEVSGKFVKYSDNGSTLSAVNFPEVSLPEHVGTKRLLHIHHNKQGVLNKINQVFVDANVNIAAQYLQTDPAIGYVVIDVETEDTHSLLTQLKEIEGTIRARVLY

SEQ ID NO: 10406 - protein, 315 aa, Pasteurella multocida subsp. multocida str. Pm70
MTIYSDNSYSIGNTPLVRLKHFGQGNIVVKVEGRNPSFSVKCRIGANMVWQAEKDGILTKEKEIVDATSGNTGIALAYVAAARGYKITLTMPETMSAERKRLLRGLGVNLVLTEGALGMKGAIAKAEEIVASDPQRYVMLKQFENPANPAIHQQTTGPEIWRDTDGQIDVLVAGVGTGGTITGISRYIKQDKGKAILSVAVEPAESPVISQTLAGEEIKPAPHKIQGIGAGFIPKNLDLALVDRVETVSSEEAMQTARRLMAEEGILGGISSGAAVAAADRLAKLPEFAEKLIVVILPSASERYLSTALFEGIEA

SEQ ID NO: 10407 - protein, 308 aa, Pasteurella multocida subsp. multocida str. Pm70
MGKIWVLGDAVVDLIPEGENTYLRCAGGAPANVAVGIARLGATTGFIGRVGDDPLGRFMLNKLQQENVCTQYMHLDPKQRTSTVIVDLKEGERSFTFMVNPSADQFLELSDLPHFNPNDWLHCCSIALINEPSRSSTFAAIHRIKAEGGFFSFDPNLRESLWNSPAEMKTVVNQVVALADVLKFSEEELLFLTDSDTLSDATAKLTQHYPDKLIIVTLGKLGATYYLQGKSQLVSSKKALIPVDTTGAGDAFVSGLLFGISQVKNWQNPTALVEIIKQANACGALATTAKGAMSALPNKQQLDAFLAE

SEQ ID NO: 10408 - protein, 387 aa, Pasteurella multocida subsp. multocida str. Pm70
MSVIKMTDLDLSGKRVFIRADLNVPVKDGKVTSDARIRATIPTLKLALEKGAKVMVTSHLGRPTEGEFDEANSLKPVVDYLNANLDVPVRLVRDYLDGVDVNQGEIVVLENVRINKGEKKNDPELGKKYAALCDVFVMDAFGTAHRAQASTYGVAEYAPVACAGPLLAAELDALGKALKEPARPMVAIVGGSKVSTKLEVLNSLSKIADQIIVGGGIANTFIAAAGHNVGKSLYEEDLIPVAKNLAASTDIPVPVDVRVGLEFSETAAATEKAVNEVKDDESIFDIGDKSAEQLAEIIKNAKTILWNGPVGVFEFPNFRKGTEIISHAIANSEGFSIAGGGDTLAAIDLFGIKDKISYISTGGGAFLEFVEGKVLPAVEILEKRANG

SEQ ID NO: 10409 - protein, 433 aa, Pasteurella multocida subsp. multocida str. Pm70
MAKIVKVIGREIIDSRGNPTVEAEVHLEGGFVGLAAAPSGASTGSREALELRDGDKARFLGKGVLKAVAAVNNEIAQALVGKDATNQAEIDQIMIDLDGTENKSKFGANAILAVSLANAKAAAAAKGMPLFAWIAELNGTPGQYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEELCKEYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGDKAPFLGLKAVKGQA

SEQ ID NO: 10410 - protein, 210 aa, Pasteurella multocida subsp. multocida str. Pm70
MSQQFFDQVSLESLSAKGSYGIGLQIGQQLLESQLEVSAEAVAKGIFDVLNQNPPALELNEVSHALQTLQQQATEAQQAKFKEIEAVGAQFLAENAQKAGVNTTESGLQYEVLVAGEGQIPAREDKVRVHYTGTLIDGTVFDSSVKRGQPAEFPVNGVIAGWIEALSMMPVGSKWRLTIPHNLAYGERGAGASIPPFSTLVFEVELLAIL

SEQ ID NO: 10411 - protein, 468 aa, Pasteurella multocida subsp. multocida str. Pm70
MKSRMLGDYNKLFRLCKYLREFTPVERAIHNRGETMNEQQLLECDRQHIWHPYAALNADFPLFVVERAEGVYIQLKNGQQLIDGMSSWWSAIHGYNHPRLNHAATQQLSQMSHVMFGGLTHQPAVELAQQLVNILPESLDKIFFADSGSVAVEVAMKMAVQYQHAKGETQRCKFATIRSGYHGDTWHAMSVCDPVTGMHSLFAKGLPVQYFLPQPPVKFGQAWQPEAMQPLQDLLAQHGDEIAGLILEPVVQGAGGMYFYSPEYLVQAKALCEQYGILLIFDEIATGFGRTGKLFACEHANVVPDVMCIGKALTGGYLTLSATITNQTVADVICSGEAKCFMHGPTFMANPLACAVAAESIKLLLASPWQQRIQQIEQQLRQELRQAEALDCVAEVRVLGAIGVIEMKAPVNMASLQPRFVQNGVWVRPFGKLVYLMPPYIISSDQLSQLIHGTIRTLQEEYAHKESL

SEQ ID NO: 10412 - protein, 236 aa, Pasteurella multocida subsp. multocida str. Pm70
MSLFLLRWNGAMLKLDLGLRSSNLKKFYHLKIFLKILLLVVEICQRTITVQKGDFVVLGGATSSVGIATIQIAKMQGANVIALSRTHAKGDVLLQKGADFVIATKEDDVTAKLLEITNGKGVNLVFDPVGGKEAAKIINAMTQDGKYIIYGALSHDDIAVPVFPILGKHLTVRGYELFEITTVPEKLAQAKKFVFDGLASGQLKPEIDKVFAFDEMAEAHRYMESNAQIGKILVKV

SEQ ID NO: 10413 - protein, 454 aa, Pneumocystis carinii
MSSPMDTVTESDMAINLALLGGIGVIHHNCTIEEQTEMVRKVKKFENGFITSPIVLSLNHRVRDVRRIKEELGFSGIPITDTGQLNGKLLGIVTSRDIQFHNNDESFLSEVITKDLVTGSEGIRLEEANEILRSCKKGKLPIVDKEGNLTALLSRSDLMKNLHFPLASKLPDSKQLICAQAVGTRPDDRIRLKHLVEAGLDIVVLDSSQGNSIYQINMIKWNKKEFPNLEVIAGNVVTREQAANLISAGADALRVGMGSGSICITQEIMAVGRPQATAVYAVSEFASKFGVPTIADGGIENIGHITKALALGASAVMMGNLLAGTTESPGQYYYRDGQRLKSYRGMGSIDAMEHLSGKNKGDNAASSRYFGEADTIRVAQGVSGSVIDKGSLHVYVPYLRTGLQHSLQDIGVQNLTELRKQVKEKNIRFEFRTVASQLEGNVHGLDSYQKKLWS

SEQ ID NO: 10414 - protein, 420 aa, Lactococcus lactis subsp. lactis Il1403
MAEHLAPLIDNQSRVALLSENSVEMAVVLFALLGLSKEVLLLNRHLTEYELADQIKELKIDKVFTSDLLTEKVTDSISFSEIWTSNPCPVSLSADFPDEKIAVIMNTSATTGKFKSVPITWGMISNHVKASKETLGAYDNDNWLVILPMFHVSGLSIIMRTLYNATSATVVDKFDENQLLEMINSGKINMVSLVPTLLTRIADKLHSNNLRLILLGGEFIPQPLIKKCQELGLPIYKTYGMTESFSQSVTFNILDFPDKTSSVGRPLPGVEIEIRQADLAGVGEIWLKSPMLMKAYLGQKPYGTAFETGDIGYLDTDGFLYLLNRRKDIIISGGENIYPKEIEDLVYSLPEIKECALVAKPDAKWGQVPILFVSGNISQEKLENFLTEKLAKYKRPQSITFMDELPKNASGKILRKELKG

SEQ ID NO: 10415 - protein, 163 aa, Arabidopsis thaliana
MADEMSLRYSLFLIFFSLISLQGFAKKTGDVSELQIGVKFKPKTCEVQAHKGDTIKVHYRGKLTDGTVFDSSFERGDPFEFKLGSGQVIKGWDQGLLGACVGEKRKLKIPAKLGYGEQGSPPTIPGGATLIFDTELIAVNEKPAGGEEYGGDEDDEGYGNDEL

SEQ ID NO: 10416 - protein, 151 aa, Vicia faba
MKLFSIFLIFTIFIIASALVAAKSAADVTELQIGVKYKPASCEVQAHKGDKVKVHYRGKLTDGTVFDSSFERNSPIDFELGGGQVIKGWDQGLLGMCLGEKRKLKIPAKLGYGEQGSPPTIPGGATLIFDTELVGVNDKSLSEEKSTSSEL

SEQ ID NO: 10417 - protein, 147 aa, Lactococcus lactis subsp. lactis Il1403
MNGETVSMSDFKGKVVIVVNTASKCGFTPQFEGLEKLYENYKDQGLEILGFPCNQFVNQDAGENSEINEFCQLNYGVTFPMFQKIKVNGKEAHPLYQFLKKEAKGALSGTIKWNFTKFLIDREGNVIERFAPKTEPKEMEEEIQKLL

SEQ ID NO: 10418 - protein, 152 aa, Pediococcus acidilactici
GVDNVPADALKKNDIKISNVPAYSPRAIAELSVTQLLALLRKIPEFEYKMAHGDYRWEPDIGLELNQMTVGVIGTGRIGRAAIDIFKGFGAKVIAYDVFRNPALEKEGMYVDTLEELYQQANVITLHVPALKDNYHMLDEKAFGQMQDGTFI

SEQ ID NO: 10419 - protein, 152 aa, Pediococcus acidilactici
GVDNVPADALKKNDIKISNVPAYSPRAIAELSVTQLLALLRKIPEFEYKMAHGDYRWEPDIGLELNQMTVGVIGTGRIGRAAIDIFKGFGAKVIAYDVFRNPALEKEGVYVDTLEELYQQANVITLHVPALKDNYHMLDEKAFGQMQDGTFI

SEQ ID NO: 10420 - protein, 152 aa, Pediococcus pentosaceus
GVDNVPVEALKRNNIKITNVPAYSPMAIAELSVTQLLALIRRIPEFDAKMARGDFRWEPDIALELNQMTVGVIGTGRIGRAAINIFKGFGAKVIAYDVFRNSELEKEGIYVDSLEELYRQVDVITLHVPALKDNYHMLNDEAFAQMHDGVFV

SEQ ID NO: 10421 - protein, 302 aa, Burkholderia pseudomallei
MKYDLPGVATLDALLRDQRAAYLRAPYPSWATRADHLRALRKMLLENRDALAAAINADFGHRAKEEVLMSEIWLAKEEIDEALKHGKRWIKPKSRTMNKWLRPARAKVMPQPLGVVGIVVPWNYPVLLAAGPLICALAAGNRAIVKMSELTPRTSQLFEELISKTFARDHVAVVNGDAQIGAAFSGLPFDHLLFTGSTNVGRHVMRAAAEHLTPVTLELGGKSPVIVGPRARFDAAVDAVITGKTLNAGQTCIAPDYVLVPRGKEAEFVARARARMARLYPNLSTNPDYTSIISERHFARLQ

SEQ ID NO: 10422 - protein, 446 aa, Streptomyces antibioticus
MHPVPAPEQPGELIARLRAASRTGRPRSLEWRTEQLTRLRSLLQEHTDALAEALFADLHKSRSEAHAAEIGFTVREIDHLLENLEEWLRPQPAAVPGCPAGSTAYVQYDPLGVVLVIAPWNYPVQLLLVPVAGALAAGNTVVAKPSEVAPACSALLARLIPQYLSRDAVAVVEGGVAETTALLAQRFDHIFYTGNGTVGRIVMRAAAEHLTPVTLELGGKSPVFVDRGTNLADTATRLARAKFANAGQTCVAPDYVLTDPDTARGLVAEIARSVRRMFGSEPELARGYGRIVNLHHFDRVVRLLGSGRIVLGGRHDRENRYIAPTVLADVAAESPVMREEIFGPVLPIVEVPGVDQAISFINDRDKPLAVYGFTAREEVPRRLAEETTSGGLVLGMPMAQVLDPGLPFGGVGESGTGSYRGAHSLAAFSHLKPVLDVPMRPTGPVG

SEQ ID NO: 10423 - protein, 185 aa, Porphyra purpurea
MKKATFITCLLAVLLVSNPIVVNAEVAGLIPCKDSAAFNKRMVNSVKKLQARLAKYDANTPPALALNKQIEKTKTRFATYGRAGLLCGTDGLPHLISDGRWSRAGDFVFPGLLFLYITGWIGWVGRGYLLSVAKTSKPTEKEIILDVPLAVKFMSSGFAWPLAAWQEFSSGQLIAPNDDITVSPR

SEQ ID NO: 10424 - protein, 173 aa, Porphyra purpurea
MPRSQKNDNFIDKTFTVLADIVLKILPTSKEEKEAFSYYRDGMSAQSEGEYAEALENYYEALKLEEDPYDRSYILYNIGLIYASNGEYIKALEYYHQGLELNFKLPQALNNIAVIYHYQGVQAVEEKNIELSKLMFDKAAQYWQQAIKLAPDNYIEAQNWLKTTGRMKNIQGY

SEQ ID NO: 10425 - protein, 273 aa, Porphyra purpurea
MIINIHINFFMTTISSVFKKLDKQCALIPFITAGDPDLVSTSKALKILDQHGADIIELGLPYSDPLADGPIIQAASSRALKQSINLNNILDMVNITSSNIVAPIVLFTYYNPVLNLGINNFISAISRAGIKGLLIPDLPIEESDYIISVCKLFNIELIFLLSPTSSIERINKIVEQAPGCIYLVSTTGVTGQKPELTGKLKRLTETIKKMTQKPIILGFGISTAEQIKEIKGWNINGIVIGSAFVKRLSSDFPEEGLRKIKDFCTTAKSIIIS

SEQ ID NO: 10426 - protein, 474 aa, Cupriavidus necator
MSKQFDVLVIGAGPGGYIAAIRAGQLGLNVACCEGNPYDDPKGEARLGGTCLNVGCIPSKALLASSEEFENVQHHLGDHGITVGDVKVDVAKMLKRKDDIVGKMTKGIEFLFRKNKVTLLKGYGKFVGKSAEGFQVDVAGEVVTAKQVIIATGSKARHLPGIKVDNDLVSDNEGALKFPAVPKKLGVIGAGVIGLELGSVWRRLGSDVTVLEALPAFLGAADEGVAKEAQKQLTKQGLKFSLGVNVNEVTTGKNGVTVKYTDKDGKAQTLEVDRLIVSVGRVPNTDNLGLDAVGLAADQRGFIEVDDHCATKVPGLWAIGDVVRGPMLAHKAEDEGVAVAERIAGQKPHIDYNCVPWVIYTFPEIAWVGKTEAQLKAEGREYKAGQFPFMANGRALGMGHADGFVKMLADAKTDEILGVHIVAANASDLIAEAVVAMEFKAASEDIGRVCHPHPSMSEVMREAALAVDKRHVNM

SEQ ID NO: 10427 - protein, 217 aa, Mangifera indica
MAGFRAEDDYDYLFKVGLIGDSGVGKSNLALRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGNLLAERESLSFMETSALEATNVDNAFAEVLSKSTALLARRLWKLVIIDQDAVPSKSEKIDVSKDVSAVKKVGCCSG

SEQ ID NO: 10428 - protein, 248 aa, Saccharomyces cerevisiae
MSFYNTSNNANNGGGFYQPSAQFAVPQGSMSFQNTVGSSNTGNDNNLGVAPDPLPVGILHALSTKGYPHEPPLLEEIGINFDHIITKTKMVLIPIRFGSGVPQEILNDSDLAGPLIFFLLFGLFLLMAGKVHFGYIYGVALFGTISLHNLSKLMSNNDTSTQTNLQFFNTASILGYCFLPLCFLSLLGIFHGLNNTTGYVVSVLFVIWSTWTSSGFLNSLLQLQNARLLIAYPLLIFYSVFALMVIFV

SEQ ID NO: 10429 - protein, 355 aa, Fusarium solani
MSRSNPPNPTGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRAIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 10430 - protein, 341 aa, Pinus taeda
MGSMGKMVMRFLQKRSLATLPSQMIEKGQNRVVEASLTLIRERAKLKAELVQALGGSIATTCLLGVPLGHNSSFLQGPAFAPPRIREAIWCGSTNSATEKGKELKDSRVLSDAGDVPIQEMRDCGIEDERLMKTVSDSVKIVMEEPPLRPLVLGGDHSISYPVVKAVTDHLGGPVDILHLDAHPDIYDAFEGNKYSHASSFARIMEGGHARRLLQVGIRSITKEGREQGKRFGVEQYEMHSFSKDRDFLENLKLGEGVKGVYISIDVDCLDPAFAPGVSHLEPGGLSFRGVMNLVQNLQGDIVAADVVEFNPQRDTVDGMTAMVAAKLVRELTSKMSKLAH

SEQ ID NO: 10431 - protein, 114 aa, Leavenworthia stylosa
LVEKFGIDPNNAFAFWDWVGGRYSVCSAVGVLPLSLQYGFSVVEKFLKGASSIDQHFKSTSLEENIPVLLGLLSVRNVSFLGYPARAILPYSQALEKFAPHIQQVSMESNGKGV

SEQ ID NO: 10432 - protein, 114 aa, Leavenworthia stylosa
LVEKFGIDPNNAFAFWDWVGGRYSVYSAVGVLPLSLQYGFSVVEKFLKGASSIDQHFKSTSLEENIPVLLGLLSVWNVSFLGYPARAILPYSQALEKFAPHIQQVSMESNGKGV

SEQ ID NO: 10433 - protein, 114 aa, Leavenworthia stylosa
LVEKFGIDPNNAFAFWDWVGGRYSVCSAVGVLPLSLQYGFSVVEKFLKGASNIDQHFKSTSLEENIPVLLGLLSVWNVSFLGYPARAILPYSQALEKFAPHIQQVSMESNGKGV

SEQ ID NO: 10434 - protein, 114 aa, Leavenworthia stylosa
LVEKFGIDPNNAFAFWDWVGGRYSVCSAVGVLPLSLQYGFSVVEKRSYLTLKPLRNLLRTFKFLKGASSIDQHFKSTSLEENIPVLLGLLSVWNVSFLGYPARQVSMESNGKGV

SEQ ID NO: 10435 - protein, 114 aa, Leavenworthia stylosa
LVEKFGIDPNNAFAFWDWVGGRYSVCSAVGVLPMSLQYGFSVVEKFLKGASSIDQHFKSTSLEENIPVLLGLLSVWNVSFLGYPARAILPYSQALEKFAPHIQQVSMESNGKGV

SEQ ID NO: 10436 - protein, 114 aa, Leavenworthia stylosa
LVEKFGIDPNNAFAFWDWVGGRYSVCSAVGVLPLSLQYGFSVVEKFLKGASSIDQHFKSTSLEENIPVLLGLLSVWNVSFLGYPARAILPYSQALEKFAPHIQQVSMESNGKGV

SEQ ID NO: 10437 - protein, 193 aa, Emericella nidulans
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRHDPKTIEELNKTSQKPVTPEQGEEVRKKIGAYKYLECSARTNEGVREVFEAATRAALLTKTHKSKKKCSIL

SEQ ID NO: 10438 - protein, 465 aa, Sladenia celastrifolia
VGFKAGVKDYKLTYYTPDYETKGTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSHPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGEREITLGFVDLLRIDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACAVWKEIKFEFEAMDTL

SEQ ID NO: 10439 - protein, 322 aa, Phyllostachys edulis
MASTLSFPVIDMGLLGGDERPAAMELLRDACENWGFFEILNHGISKELMDEVEKMTKGHYKMVREQRFLEFASKTLKDGCDAQGVKAENLDWESTFFVRHLPESNITEIPDLDDDYRRVMKRFAAELEKLAEGLLDLLCENLGLEKGYLARAFRGSKGAPTFGTKVSSYPPCPRPDLVKGLRAHTDAGGIILLFQDDHVSGLQLLKDGEWVDVPPMRHSIVVNLGDQLEVITNGRYKSVLHRVVAQTDGNRMSIASFYNPGSDAVIFPAPALVEEEAGGTYPKFVFEDYMNLYVRHKFEDKEPRFEAFKSMERESSKRIAIA

SEQ ID NO: 10440 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQTVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 10441 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIVGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 10442 - protein, 475 aa, Aegopodium podagraria
  misc_feature (1)..(5): Xaa can be any naturally occurring amino acid
XXXXXETKASVGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHNHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVKARNEGRDLASEGNEIIREATKWSPELAAACEVWKEIKFEFQAMDTL

SEQ ID NO: 10443 - protein, 475 aa, Bupleurum falcatum
  misc_feature (1)..(8): Xaa can be any naturally occurring amino acid
  misc_feature (14)..(14): Xaa can be any naturally occurring amino acid
  misc_feature (18)..(18): Xaa can be any naturally occurring amino acid
XXXXXXXXASVGFXAGVXDYKLTYYTPEYETKDTDILAAFRVTPQPGVPPEEAGAAVAAESSTGTWTTVWTDGLTSLDRYKGRCYGIEPVPGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGERDITLGFADLLRDDFIDKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 10444 - protein, 475 aa, Donnellsmithia cordata
  misc_feature (1)..(4): Xaa can be any naturally occurring amino acid
  misc_feature (464)..(465): Xaa can be any naturally occurring amino acid
XXXXTETKASVGFKAGVKDYKLTYYTPEYETKDTDILAAFRVTPQPGVPPEEAGAAVAAESSTGTWTTVWTDGLTSLDRYKGRCYEIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASEGNEIIREATKWSPELAAACEVWKXXKFEFQAMDTL

SEQ ID NO: 10445 - protein, 475 aa, Eremocharis fruticosa
  misc_feature (1)..(6): Xaa can be any naturally occurring amino acid
  misc_feature (24)..(24): Xaa can be any naturally occurring amino acid
  misc_feature (98)..(99): Xaa can be any naturally occurring amino acid
  misc_feature (120)..(120): Xaa can be any naturally occurring amino acid
XXXXXXTKASVGFKAGVKDYKLTXYTPDYETKDTDILAAFRVTPQPGVPPEEAGAAVAAESSTGTWTTVWTDGLTSLDRYKGRCYEIEPVPGEENQYXXYVAYPLDLFEEGSVTNMFTSXVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLASEGNEIIREAAKWSPELAAACEVWKEIKFEFQAMDTL

SEQ ID NO: 10446 - protein, 475 aa, Hydrocotyle bowlesioides
  misc_feature (1)..(9): Xaa can be any naturally occurring amino acid
  misc_feature (387)..(387): Xaa can be any naturally occurring amino acid
XXXXXXXXXSVGFKAGVKDYKLTYYTPEYETKDTDILAAFRVTPQPGVPPEEAGAAVAAESSTGTWTTVWTDGLTSLDRYKGRCYEIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTTLAHYCRDNGLLLHIHRAMHAVIDRQKNHGMHFRVLAKGLRMSGGDHIHSGTVVGKLEGERDITLGFVDLLRDDFIEKDRSRGIYFTQDWVSLPGVLPVASGGIHVWHXPALTEIFGDDSVLQFGGGTLGHPWGNAPGAVANRVALEACVQARNEGRDLAREGNEIIREAAKWSPELAAACEVWKEIKFEFQAVDTI

SEQ ID NO: 10447 - protein, 475 aa, Hydrocotyle verticillata
  misc_feature (1)..(6): Xaa can be any naturally occurring amino acid
  misc_feature (9)..(9): Xaa can be any naturally occurring amino acid
XXXXXXTKXSVGFKAGVKDYKLTYYTPEYETKDTDILAAFRVTPQPLVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFQAMDTL

SEQ ID NO: 10448 - protein, 478 aa, Micropleura renifolia
  misc_feature (1)..(6): Xaa can be any naturally occurring amino acid
XXXXXXTKASVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTTLAHYCRDNGLLLHIHRAMHAVIDRQKNHGMHFRVLAKELRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASQGNEIIREAAKWSPELAAACEVWKAIKFEFEAMDTLDVK

SEQ ID NO: 10449 - protein, 475 aa, Neogoezia minor
  misc_feature (1)..(8): Xaa can be any naturally occurring amino acid
  misc_feature (10)..(10): Xaa can be any naturally occurring amino acid
  misc_feature (116)..(116): Xaa can be any naturally occurring amino acid
XXXXXXXXAXVGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNXFTSIVGNVFGFKALRALRLEDLRIPVSYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIAKDRSRGIYFTQDWVSLPGVLPVASGGIHVWHMPALTEIFGDDSVLQFGGGTLGHPWGNAPGAVANRVALEACVQARNEGRDLASEGNEIIREATKWSPELAAACEVWKEIKFEFQAMDTL

SEQ ID NO: 10450 - protein, 475 aa, Pimpinella saxifraga
  misc_feature (1)..(4): Xaa can be any naturally occurring amino acid
  misc_feature (53)..(53): Xaa can be any naturally occurring amino acid
XXXXTETKASVGFKAGVKDYKLTYYTPEYETKDTDILAAFRVTPQPGVPPEEXGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 10451 - protein, 475 aa, Cussonia spicata
  misc_feature (1)..(3): Xaa can be any naturally occurring amino acid
  misc_feature (448)..(448): Xaa can be any naturally occurring amino acid
XXXQTETKASVGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMMKRAVFARELGVPIVMHDYLTGGFTANTTLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASEGNEIIREXAKWSPELAAACEVWKEIKFEFQAMDTL

SEQ ID NO: 10452 - protein, 475 aa, Kalopanax pictus
  misc_feature (1)..(5): Xaa can be any naturally occurring amino acid
XXXXXETKASVGFKAGVKDYRLTYYTPDYETKDTDILAAFRVTPQPGVPPEEAGAAVAAESSTGTWTTVWTDGLTSLDRYKGRCYGIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKGLRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFAAVDVL

SEQ ID NO: 10453 - protein, 475 aa, Melanophylla alnifolia
  misc_feature (1)..(5): Xaa can be any naturally occurring amino acid
  misc_feature (116)..(116): Xaa can be any naturally occurring amino acid
  misc_feature (120)..(120): Xaa can be any naturally occurring amino acid
  misc_feature (221)..(222): Xaa can be any naturally occurring amino acid
XXXXXETKASVGFKAGVKDYKLTYYTPDYETKDTDILAAFRVTPQPGVPPEEAGAAVAAESSTGTWTTVWTDGLTSLDRYKGRCYEIEPVAGEENQYIAYVAYPLDLFEEGSVTNXFTSXVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFXXEAIFKAQAETGEIKGHYFNATAGTCEEMIKRAVFARELGVPIVMHDYLTGGFTANTSLAHYCRDNGLLLHIHRAMHAVIDRQKNHGMHFRVLAKGLRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIREAAKWSPELAAACEVWKEIKFEFQAMDTL

SEQ ID NO: 10454 - protein, 477 aa, Mackinlaya macrosciadia
  misc_feature (1)..(6): Xaa can be any naturally occurring amino acid
  misc_feature (9)..(10): Xaa can be any naturally occurring amino acid
  misc_feature (24)..(24): Xaa can be any naturally occurring amino acid
  misc_feature (86)..(86): Xaa can be any naturally occurring amino acid
  misc_feature (99)..(99): Xaa can be any naturally occurring amino acid
  misc_feature (131)..(131): Xaa can be any naturally occurring amino acid
  misc_feature (468)..(468): Xaa can be any naturally occurring amino acid
XXXXXXTKXXVGFKAGVKDYKLTXYTPDYITKDTDILAAFRVTPQPGVPPEEAGAAVAAESSTGTWTTVWTDGLTSLDRYKGRCYXIEPVAGEENQYIXYVAYPLDLFEEGSVTNMFTSIVGNVFGFKALXALRLEDLRIPVSYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRLSGGDHVHAGTVVGKLEGERDITLGFVDLLREDFVEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFXFEAMDTLDK

SEQ ID NO: 10455 - protein, 475 aa, Munroidendron racemosum
  misc_feature (1)..(5): Xaa can be any naturally occurring amino acid
  misc_feature (448)..(448): Xaa can be any naturally occurring amino acid
XXXXXETKASVGFKAGVKDYKLTYYTPDYQTKDTDILAAFRVTPQPGVPPEEAGAAVAAESSTGTWTTVWTDGLTSLDRYKGRCYGIEPVTGEENQFIAYVAYPLDLFEEGSVTNMFTSIVGNVFGFKALRALRLEDLRIPVAYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFVAKDRSRGIYFTQDWVSLPGVLPVASGGIHVWHMPALTEIFGDDSVLQFGGGTLGHPWGNAPGAVANRVALEACVQARNEGRDLAREGNEIIREXAKWSPELAAACEVWKEIKFEFEAMDTL

SEQ ID NO: 10456 - protein, 475 aa, Meryta sinclairii
  misc_feature (1)..(6): Xaa can be any naturally occurring amino acid
  misc_feature (9)..(10): Xaa can be any naturally occurring amino acid
  misc_feature (24)..(24): Xaa can be any naturally occurring amino acid
  misc_feature (465)..(465): Xaa can be any naturally occurring amino acid
XXXXXXTKXXVGFKAGVKDYKLTXYTPEYETKDTDILAAFRVTPQPGVPPEEAGAAVAAESSTGTWTTVWTDGLTSLDRYKGRCYGIEPVTGEENQYIAYVAYPLDLFEEGSVTNMFTSIVGNVFGFKALRALRLEDLRVPVAYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGTPIVMHDYLTGGFTANTTLAHYCRDNGLLLHIHRAMHAVIDRQKNHGIHFRVLAKALRMSGGDHIHSGTVVGKLEGERDITLGFVDLLRDDFIAKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEXKFEFQAMDTL

SEQ ID NO: 10457 - protein, 478 aa, Panax quinquefolius
  misc_feature (1)..(6): Xaa can be any naturally occurring amino acid
  misc_feature (24)..(24): Xaa can be any naturally occurring amino acid
XXXXXXTKASVGFKAGVKDYKLTXYTPDYDPKDTDILAAFRVTPQPGVPAEEAGAAVAAESSTGTWTTVWTDGLTSLDRYKGRCYKIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYITGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAVDILDVV

SEQ ID NO: 10458 - protein, 475 aa, Tetrapanax papyriferus
  misc_feature (1)..(11): Xaa can be any naturally occurring amino acid
XXXXXXXXXXXGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLASEGNEIIREAAKWSPELAAACEVWKEIKFEFQAVDTL

SEQ ID NO: 10459 - protein, 475 aa, Sollya heterophylla
  misc_feature (1)..(6): Xaa can be any naturally occurring amino acid
  misc_feature (10)..(10): Xaa can be any naturally occurring amino acid
  misc_feature (24)..(24): Xaa can be any naturally occurring amino acid
  misc_feature (98)..(98): Xaa can be any naturally occurring amino acid
  misc_feature (120)..(120): Xaa can be any naturally occurring amino acid
  misc_feature (445)..(445): Xaa can be any naturally occurring amino acid
  misc_feature (468)..(468): Xaa can be any naturally occurring amino acid
XXXXXXTKAXVGFKAGVKDYKLTXYTPDYQTKDTDILAAFRVTPQPGVPPEEAGAAVAAESSTGTWTTVWTDGLTSLDRYKGRCYEIEPVAGEENQFXAYVAYPLDLFEEGSVTNMFTSXVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLASEGNEIXREAAKWSPELAAACEVWKEIKFXFQAMDTL

SEQ ID NO: 10460 - protein, 246 aa, Methanothermobacter thermautotrophicus
MVSLTKRCIAEFIGTFILVFFGAGSAAVTLMIASGGTSPNPFNIGIGLLGELGDWVAIGLAFGFAIAASIYALGNISGCHINPAVTIGLWSVKKFPGREVVPYIIAQLLGAAFGSFIFLQCAGIGAATVGGLGATAPFPGISYWQAMLAEVVGTFLLMITIMGIAVDERAPKGFAGIIIGLTVAGIITTLGNISGSSLNPARTFGPYLNDMIFAGTNLWNYYPIYVIGPIVGAVLAALTYQYLTSE

SEQ ID NO: 10461 - protein, 1012 aa, Phaseolus vulgaris
  misc_feature (860)..(860): Xaa can be any naturally occurring amino acid
MLILVGSKQGTMSSLASPVSLGSLMGVSSSGRSHSGVRRVSFSRGNCKGRKRWHCLSLSVCRYSVTTTDFIADQGNSVSLDSNSNSSSSSKSGGDDGTGFVLKPPPKPVLKAPDNRMTHLGPSRTTGDVEERNKVIESLGEVLEKAEKLGSSKVNGDKNNGSVNKPVRNNANASPRTERPVNSAASLKSKTLKSVWRKGDSVASVQKVVKEVPKPSYNKNEEEKSQTRGGEKVVSQTRAPQPPSKPQPLKPQQPSKPQPALLSKPSIAPPPVKKPVVLRDKGAAETSVKSKEKKSPILIDKFASKKPVVDPLIAQAVLAPPKPGKAPSPGKFKDDFRKKGALAGGGRRRRILDDEDVIQDASELNVSIPGAATARKGRKWSKASRKAARLQAARDAAPVKVEILEVGDSGMLVEELAYCLATSEGEILGYLYSKGIKPDGVQTIDKDMVKMICKEYDVEVIDADPVKVEGLVKKREILDEDDLDKLKDRPPVITIMGHVDHGKTTLLDYIRKSKVAASEAGGITQGIGAYKVQVPFDGKTLPCVFLDTPGHEAFGAMRARGASVTDIAVIVVAADDGIRSQTNEAIAHAKAAGVPIVIAINKIDKDGANPERVMQELSSIGLMPEDWGGNTPMVPISALKGKNVDDLLETVMLVAELQELKANPDRSAKGTVIEAGLDKSKGPLATFIVQNGSLRRGDIVVCWRSFWKGRALFDDGGKRVDEATPSIPVQVIGLNNVPIAGDVFEVVESLDAARERAETRAESLRNERISAKAGDGKITLSSLASAVSSGKLSGLDLHQLNIILKVDLQGSIEAVRKALQVLPQENVTLKFLLEATGDVNTSDVDLAVASKAIIMGFNAXTPGSVKSYADNKAVEIRLYRVIYELIDDVRKAMEGLLEPVEEQLTIGSAVVRAVFSSGSGRVAGCMVTEGKVLKDCGIRVKRKGKIVHVGIIDSLRRVKEIVKEVNAGLECGLGLEDFDDWEEGDIIEPSTQLRRRGPLKRPQHQWQLLWRE

SEQ ID NO: 10462 - protein, 212 aa, Haloferax volcanii
QSQCDRTSKLIELSRQFYFPCRLDICVMRNINQIQLGLNGPFVSSLGLGCMRMSSIWGGVTPDESESIATINEALDLGINFLNTGDFYGAGHNEMLIGKAIKGRRDDAFISVKFGAIFHNGQWLGLDLKPNSIKNFVNYSLTRLGIDTIDLYQPSRMDGSVPLEDIIGTVAELVSEGKVRYIGVSEITAEQLRMANDIHPISALEIGYSLAV

SEQ ID NO: 10463 - protein, 483 aa, Oryza sativa
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDNLFIVDEVITGFERLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 10464 - protein, 339 aa, Ralstonia metallidurans CH34
MVCNSIIESIGNTPLVHVRRLFGRADAEVFAKLELLNPAGSVKDRPARYIVEKGLTEGAIGPHSHVIESSSGNLAIALAMICGLKGLRFTAVVDPKISPTNLKILRCYGAGIEQVTAKDSQGGYLETRIERVRQMLREQRDAIWINQYANPLNWESHYYGEAAEILAHVAQPADVLVLGVTTSGTVHGIARRLRKAWPSMRVVGVDAVFPCCSANRRKRASCRALAPRRAGIAVPGRDRRSDPYRRLHRRHGAGACWRRRHLRGGSSGAVVAAIEQVLHATPVSHRPLRILTLFPDRGERYLDTVYDDAWLARIAARTAVPNLAALPTVASLIPAGVSA

SEQ ID NO: 10465 - protein, 465 aa, Pseudomonas straminea
MTSQTSKQNTDPTVVNVQTVLNESPFSGFQWGIFFLCFLIVLLDGFDTAAIGFIAPSLLGEWGIDKSHLGPVLSAALFGLAFGALGAGPLADRVGRKTVLIIAAVVMGGASIASGLVHDLQGLTIWRFITGLGLGAAMPNAITLMNEYCPDSKRSFITNCMFCGFPIGSAFGGFIAAWMIPHFGWRSLLIVGGVVPLILAVLMIVMLPESVRFMVLKNYSADRVRKVMVRIAAGTRNAARFVLNDGGAAAAQAQQGPQGLRLVFSQKYLVGTLALWVTYFMGLVIVYGLVNWMPVLFKEAGVPASQAAVIAALFQLGGVGAIFVGLLMDRWNANLIIAAGYFLTSLGVAFIGQVLGGGVGMLVASVFIAGLLMNAAQSSMQALAAEYYPTECRASGVSWMLGIGRFGGIAGSFLVAELSRRHLELPQVFMVVAIPGVIAALALLVKNRYAGGAPRTSMLGLGGAH

SEQ ID NO: 10466 - protein, 159 aa, Haemophilus influenzae
MFRAAIKAGTELGKQAKALMDEGKLVPDELTVALVKDRIAQADCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKVGNTQ

SEQ ID NO: 10467 - protein, 159 aa, Haemophilus influenzae
MFRAAIKAGTELGKQAKALMDEGKLVPDELTVALVKDRIAQPDCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKEGNTQ

SEQ ID NO: 10468 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTN

SEQ ID NO: 10469 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKASKDESAVAKHFAALSTNAKDVEKFGIDTN

SEQ ID NO: 10470 - protein, 156 aa, Haemophilus influenzae
NRANIPVLVDGKDVMPEINAVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 10471 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAATDESAVAKHFAALSTNAKDVEEFGIDTN

SEQ ID NO: 10472 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 10473 - protein, 379 aa, Clostridium acetobutylicum ATCC 824
MKSTKILILGAGPAGFSAAKAALGKCDDITMINSEKYLPYYRPRLNEIIAKNKSIDDILIKKNDWYEKNNIKVITSEFATSIDPNNKLVTLKSGEKIKYEKLIIASGSIANKIKVPHADEIFSLYSYDDALKIKDECKNKGKAFIIGGGILGIELAQAIIDSGTPASIGIILEYPLERQLDRDGGLFLKDKLDRLGIKIYTNSNFEEMGDLIRSSCVITAVGVKPNLDFIKDTEIASKRGILVNDHMETSIKDIYACGDVAEFYGKNPGLINIANKQGEVAGLNACGEDASYSEIIPSPILKVSGISIISCGDIENNKPSKVFRSTQEDKYIVCMLKENKIDAAAVIGDVSLGTKLKKAIDSSKSFDNISSLDAILNNL

SEQ ID NO: 10474 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 10475 - protein, 331 aa, Triticum turgidum
MTQNLGISVPIMSPSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQVCFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 10476 - protein, 331 aa, Triticum turgidum
MTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYGRTRLANDAKASKGGGDRQFNGLVDVYRKTLKSDGIAGLYRGFNISCVGIIVYRGLYFGLYDSLKPVLLTGTLQVCSFASFALGWLITNGAGLASYPIDTVRRRMMMTSGEAVKYKSSLDAFQQIPAKEGAKSLFKGAGANILRAIAGAGVLSGYDQLQILFFGKKYGSGGA

SEQ ID NO: 10477 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFEQAKKFGVTEFVNPKDYNKPVQEAIVEMTGGGVDRSVECTGSIQAMISAFECVHDGWGVAVLVGVPNKDDAFKTHPVNLLNEKTVKGTFFGNYKPRSDIPAVVEKYMNKELELDKFITHTVPFSEINKAFELMLAGEGLRCVIRMDE

SEQ ID NO: 10478 - protein, 361 aa, Sinorhizobium meliloti
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEF

SEQ ID NO: 10479 - protein, 220 aa, Saccharomyces cerevisiae
MDKHTAAIPTLTIKVVLLGESAVGKSSIVLRFVSDDFKESKEPTIGAAFLTKRITRDGKVIKFEIWDTAGQERFAPLAPMYYRNAQAALVVFDVTNEGSFYKAQNWVEELHEKVGHDIVIALVGNKMDLLNNDDENENRAMKAPAVQNLCERENLLYFEASAKTGENIYQIFQTLGEKVPCPEQNTRQSSTHDRTITDNQRIDLESTTVESTRETGGCNC

SEQ ID NO: 10480 - protein, 319 aa, Lycopersicon hirsutum
MGSKYSKATNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYALRLQESVI

SEQ ID NO: 10481 - protein, 314 aa, Lycopersicon hirsutum
MGSKYSKATNSISDASNSFESYRFPLVDLEEATNNFDDKFVIGESGFGKVYRGVLRDGTKVALKRHNRDSRESIEEFETEIEILPRRSHPHLVSLIGYCDDRNEMILIYDYMENGNLKSHLTGSDLPSMSWEQRLEICIGAARGLLYLHTNGVIHRDVKSTNILLDENFVPKITDFGLSKKGPQLYQTHVSTNVKGTFGYMDPEYVIRQKLTEKSDVYSFGVVLFEVFCARSTIDPYLRREIVTLAEWAVKSHNNGQLEQIVDPNLAAKIRPESLRKFGETAVKCLALSGKDRPSMGDVLWKLEYALCLQESVI

SEQ ID NO: 10482 - protein, 320 aa, Lycopersicon hirsutum
MGSKYSKATNSINDASNLSYGVPFENYRVPFVDLDEATNNFDDKFFIGEGGFGKVYRGVLRDGTKVALKRHNHDSRQSIKEFETEIEILSFCSHPHLVSLIGFCDERNEMILIYDYMENGNLKSHLYGSDLPTMSMSWEQRLEICIGAARGLHYLHTNGVIHRDVKSSNILLDENFVPKITDFGISKTMSELDQTHLSTAVKGNIGYIAPEYALWGQLTEKSDVYSFGVVLLEVLCARPALDLSEMMSLGDETQTMGQLEQIVDPTIAAKIRPESLRMFGETAIKCIAPSSKNRPSMGDVLWKLEYALCLQEPTIQDDPE

SEQ ID NO: 10483 - protein, 323 aa, Lycopersicon hirsutum
MGTNYSKPTTSINDASNLRNRVPFESFRVPFVDLQEATNNFDDKFLIGVGIFGKVYRGVLRDGTKVALKRRKPESPQGFEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTMPEFDQTHLSTMVQGSIGYIDPEYFIRRQLTKKSDVYSFGVVLFEVLCARPAISRSHMISLAEWAVETQKMGQLEQIVDPTIVAKIRPESLRMFGETAVKCLASSSENRPSMGDVLWKLEYALHLQEPIIQDNPE

SEQ ID NO: 10484 - protein, 319 aa, Pseudomonas huttiensis
MLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 10485 - protein, 1953 aa, Saccharomyces cerevisiae
MLKNSGSKHSNSKESHSNSSSGIFQNLKRLANSNATNSNTGSPTYASQQQHSPVGNEVSTSPASSSSFRKLNAPSRSTSTEARPLNKKSTLNTQNLSQYMNGKLSGDVPVSSQHARSHSMQSKYSYSKRNSSQASNKLTRQHTGQSHSASSLLSQGSLTNLSKFTTPDGKIYLEMPSDPYEVEVLFEDIMYKRNIFQSLSEDKQEALMGYSIEKKWLIVKQDLQNELKKMRANTTSSSTASRTSMASDHHPILTANSSLSSPKSVLMTSASSPTSTVYSNSLNHSTTLSSVGTSTSKGKKLVSGSLKKQPSLNNIYRGGAENNTSASTLPGDRTNRPPIHYVQRILADKLTSDEMKDLWVTLRTEQLDWVDAFIDHQGHIAMANVLMNSIYKTAPRENLTKELLEKENSFFKCFRVLSMLSQGLYEFSTHRLMTDTVAEGLFSTKLATRKMATEIFVCMLEKKNKSRFEAVLTSLDKKFRIGQNLHMIQNFKKMPQYFSHLTLESHLKIIQAWLFAVEQTLDGRGKMGSLVGASDEFKNGGGENAILEYCQWTMVFINHLCSCSDNINQRMLLRTKLENCGILRIMNKIKLLDYDKVIDQIELYDNNKLDDFNVKLEANNKAFNVDLHDPLSLLKNLWDICKGTENEKLLVSLVQHLFLSSSKLIEENQNSSKLTKQLKLMDSLVTNVSVASTSDEETNMNMAIQRLYDAMQTDEVARRAILESRALTKKLEEIQAERDSLSEKLSKAEHGLVGQLEDELHERDRILAKNQRVMQQLEAELEELKKKHLLEKHQQEVELRKMLTILNSRPEESFNKNEGTRGMNSSLNSSEKANIQKVLQDGLSRAKKDYKDDSKKFGMTLQPNKRLKMLRMQMENIENEARQLEMTNFAEFEKDRLEPPIHIKKPKVKKMKNKDRKPLVKPQEADVNKLNDLRRALTEIQMESNDISKFNVEERVNELFNEKKSLALKRLKELETKYKGFGIDFNVDEIMDSPKKNTGDVETEEDANYASLDPKTYQKKLDEINRITDQLLDIQTQTEHEIQVEEDGESDLSSSSSDDESEEIYQDASPTQELRSEHSELSSGSGPGSFLDALSQKYGTGQNVTASAAFGENNNGSGIGPLHSKVEKTFMNRLRKSTVSSAPYLEELTQKVNKVEPYEQNEDEGLDKKSLPENSTASAASAFDKAEKDMRQHVENGKQGRVVNHEEDKTADFSAVSKLNNTDGAEDLSTQSSVLSSQPPPPPPPPPPVPAKLFGESLEKEKKSEDDTVKQETTGDSPAPPPPPPPPPPPPMALFGKPKGETPPPPPLPSVLSSSTDGVIPPAPPMMPASQIKSAVTSPLLPQSPSLFEKYPRPHKKLKQLHWEKLDCTDNSIWGTGKAEKFADDLYEKGVLADLEKAFAAREIKSLASKRKEDLQKITFLSRDISQQFGINLHMYSSLSVADLVKKILNCDRDFLQTPSVVEFLSKSEIIEVSVNLARNYAPYSTDWEGVRNLEDAKPPEKDPNDLQRADQIYLQLMVNLESYWGSRMRALTVVTSYEREYNELLAKLRKVDKAVSALQESDNLRNVFNVILAVGNFMNDTSKQAQGFKLSTLQRLTFIKDTTNSMTFLNYVEKIVRLNYPSFNDFLSELEPVLDVVKVSIEQLVNDCKDFSQSIVNVERSVEIGNLSDSSKFHPLDKVLIKTLPVLPEARKKGDLLEDEVKLTIMEFESLMHTYGEDSGDKFAKISFFKKFADFINEYKKAQAQNLAAEEEERLYIKHKKIVEEQQKRAQEKEKQKENSNSPSSEGNEEDEAEDRRAVMDKLLEQLKNAGPAKSDPSSARKRALVRKKYLSEKDNAPQLLNDLDTEEGSILYSPEAMDPTADTVIHAESPTPLATRGVMNTSEDLPSPSKTSALEDQEEISDRARMLLKELRGSDTPVKQNSILDEHLEKLRARKERSIGEASTGNRLSFK

SEQ ID NO: 10486 - protein, 1579 aa, Saccharomyces cerevisiae
MSHSDYFNYKPYGDSTEKPSSSKMRQSSSSSSSRLRSESLGRNSNTTQARVASSPISPGLHSTQYFRSPNAVYSPGESPLNTVQLFNRLPGIPQGQFFHQNAISGSSSSSARSSRRPSNIGLPLPKNPQQSLPKLSTQPVPVHKKVEASKTESEIIKKPAPVNSNQDPLLTTPTLVISPELASLNTTNTSIMSTPQNITNQTSNKHIPTRSQPNGSTSSSTLQDIVTTNSSQRSVGHHGGSTTSLRTYKKQYVLNEQLYLRKMRNRANDDYYTRGIVASSNFEDDEENFSNKGEDDLELEMDDLLKVEGEDKDNDFNFGYNFITSSTKNNENVVSMSLNYLKGKLDWLRDVNNDQPCEIEDEEWHSILGSEDLLSKLLQNPMVNNRFEWQTMLSKVLKGDIVRNEKTKIANQGKGPGFNTQFSDDIWIELKAWMNGRTVEDQNKSLRIFRDSTDSVFQEIMAFKLEDNMSADEAAETIKSLVDKYYRVLNLWPNIKRMHAEKPITKTEAFRNRIDTLNSWLNFKFNFDTNIAYLKKWIVGNKELESTTEVDNTTVNLDDPAVFATNCKRFAEQIMKEKDIELIFQKKIFFPLAPWILKAKFFFLKYQKTWNELNLSYLDQDLEFLLMFPMRLVKDIILIRLSYAKKIQNPTLMMIDQMMDDFSTYIKLAVQMKFTVASYCNDWFFKVKIDPEFDHTVVEGLEYFFSILELRILYSGKNSFKTSKEPDLLLKYWEMFRNVGYYIDDAGELIAAEFTKLTLRLVHRLHAYLLRQQNTPPKLENEAAAEKWLVQIFEILGSMKRKLNRFTNILTKAFQNFVRYKIEDHNYLLKQLKETGHFLIYTGGYLEQNGTYLIGSPELLGCKDDDILRIIKNSDIGCDLVPKLEINNSLTIYNALDDNWNSNSSLGSDISNDGTPFYYIKNDLTTQPRSYNGNRVNREPDFENSRSTEEEFYELETRLNSLGYVLVLTPQEPLLWEGEMYNLSDNKTIKPEGLNLKVIPNSIDLMCQGSSYALEYQCDRFQQISGSSVSFLEKKSSSETVKNNLQRINKAYFRCTYSVLKNYTKIVTTFKKVSPVNDLLNNIFLFGRDFGLNFLRINVANNEKRSIIILLMMRLSIGWLKFLAEDCDPTDQRVFRWCVTSMEFAMHMVSGWNILALDECQFSSLKQKISECMSLLISHFDIIGARSIEVEKINQQARSNLDLEDVFDDDMMLQVNSEFRVQSIMELEERIKRNPHQTGKVIDDSDKGNKYLVSLASSISNVSMRWQKRNFIGGGTFGRVYSAVDLDNGEILAVKEINIQDSKSMQKIFPLIKEEMSVLEILNHPNIVSYYGVEVHRDKVNIFMEYCEGGSLAALLEHGRIEDEMVTQVYTLQLLEGLAYLHESGIVHRDVKPENILLDFNGVIKYVDFGAAKKIANNGTRLASMNKIENADGEHEDVTHVSDSKAVKNNENALLDMMGTPMYMAPESITGSTTKGKLGADDVWSLGCVVLEMITGRRPWANLDNEWAIMYHVAAGHTPQFPTKDEVSSAGMKFLERCLIQNPSKRASAVELLMDPWIVQIREIAFGDDSSSTDTEERE

SEQ ID NO: 10487 - protein, 503 aa, Aspergillus awamori
MRPFTALAALCGLFLSSNSLVYADSAPSSSPVALPRDFKPPQVFKNANLVRNTNLEKGYLRETVNVVVENVDKKPQSDYYLSFPSDLYDKVGALEVRDKSAPEQGRFEVEATEFDSSRDFQYFVVHLPKPLAPSSQITLGISYSALNTLKPRPAAISQNDRQYLAYAFSAYAPSAYTTTTQKTKIKFPSTNVPDYTSTDLTSGADPERQGATYTYGPYADVAPETTYPASVRYEFTKPVITATLLERDLEVSHWGGNLATEERYWLRNNGSKLTDNFNRVEWTISSYQQLPSSAIRELKIPLKPGSVDPYFTDDIGNVSTSRYRPGKVPNRDASLELRPRFPIFGGWNYSFRIGWNNDLSAFLRKAVTGADSYVLKVPFIEGPKVSEGIQYEKAVVRIILPEGARNVRYELLEKATSNGLPGANQIQTELTSHKTFMDTLGRTALTLTVEELTDEARDSQIVVTYDYSLWDGLRKPVTITAGLFTVFVAAWAIGNIDVSIKKR

SEQ ID NO: 10488 - protein, 467 aa, Abrophyllum ornans
SVGFKAGVKDYKLTYYTPDYETKDTDILAAFRVTPQPGVPPEEAGAAVAAESSTGTWTTVWTDGLTSLDRYKGRCYHIEPVPGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFVAEALYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLASEGNEIIRGASKWSPELAAACEVWKEIKFEFQAMDTLD

SEQ ID NO: 10489 - protein, 467 aa, Goodenia ovata
SVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGRVANRVALEACVQARNEGRDLAIEGNEIIRRASKWSPELAAACEVWKEIKFEFQAMDTLD

SEQ ID NO: 10490 - protein, 466 aa, Lonicera orientalis
SVGFKAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPAAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMIKRAVFARELGVPIVMHDYLTGGFTANTTLAHYCRDNGLLLYIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARDGNEIIRAACKWSPELAAACEVWKEIKFEFEAMDTL

SEQ ID NO: 10491 - protein, 467 aa, Nymphoides peltata
  misc_feature (158)..(158): Xaa can be any naturally occurring amino acid
SVGFKAGVKDYKLTYYTPEYETKETDILAAFRVTPQPGVPPEEAGAAVAAESSTGTWTTVWTDGLTSLDRYKGRCYFIEPVPGEDNQYICYVAYPLDLFEEGSVTNMFTSIVGNVFGFKALRALRLEDLRIPVAYVKTFQGPPHGIQVERDKLNKYGXPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAAEGNEIIREASKWSPELAAACEVWKEIKFEFQAVDTLD

SEQ ID NO: 10492 - protein, 467 aa, Velleia paradoxa
SVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIRKASKWSPELAAACEVWKEIKFEFQAMDTLD

SEQ ID NO: 10493 - protein, 466 aa, Viburnum rhytidophyllum
SAGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPLAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNPPGAVANRVALEACVQARNEGRDLAREGNEVIREACKWSPELAAACEVWKEIKFEFEAMDTL

SEQ ID NO: 10494 - protein, 220 aa, Eustoma grandiflorum
AHATFYGGGDASGTMGGACGYGNLYSQGYGTNTAALSTALFNNGLSCGSCYTIRCDSSSAGKWCLNGMITVTATNFCPPNPSLPNDDGGWCNPPRQHFDLAEPAFLQIAQYRAGIVPVEFMRVPCRKKGGIRFVINGHSYFNLVLVTNVGGAGDVHSVSIKGSRTGWQPMSRNWGQNWQNNAYLNGQALSIQVTTSDGRTVTSNTVAPADWQFGQTIFGG

SEQ ID NO: 10495 - protein, 426 aa, Sporosarcina pasteurii
MLLTKEKNGMEIIEERESAVRSYSRSFPTVFEKAKDHLVWDVDGKEYIDFFAGAGSLNYGHNNEKMKTKIMDYVMNDGISHSLDMGTVARAEFLETFNEVILRPRNLDYKVMFPGPTGTNTVESALKIARKVTGRQNIISFTNAFHGMTLGSLSISGNSSIRNGAGVPLTNTISMPYDTFFKNGNAIDYLEQYLEDTGSGVDLPAAMILETVQGEGGINAASFEWLRGIEKLCRRYDILLIIDDVQAGCGRTGTFFSFEPAGIQPDIVCLSKSIGGYGLPLAITLIKPEHDIWEPGEHNGTFRGNNMAIVAATEALSYWKTDDLAKSVQKKSKIIKLRFEQIVEDYPELKATTRGRGFMQGIACGKGKEAYATKICAKAFEKGVIMETSGPSGEVVKFLGALTIDETSLIKGLGILEEATEEVVRQ

SEQ ID NO: 10496 - protein, 110 aa, Manihot esculenta
DMFMHLDVNTEIYPMAVGDKFTMALAHTLNLDGTPDTGYYIQGARKTLADKYEYIMHGKLYKISEEGSGKAVKAEIYVSYGGLLMMLKGDPSHVSHFELDQRLFLLIRKL

SEQ ID NO: 10497 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRSTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 10498 - protein, 337 aa, Saccharomyces cerevisiae
ILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 10499 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 10500 - protein, 221 aa, Saccharomyces cerevisiae
  misc_feature (1)..(1): Xaa can be any naturally occurring amino acid
XSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADFLNKLGKN

SEQ ID NO: 10501 - protein, 221 aa, Saccharomyces cerevisiae
  misc_feature (1)..(1): Xaa can be any naturally occurring amino acid
XSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKN

SEQ ID NO: 10502 - protein, 296 aa, Streptomyces coelicolor A3(2)
MAERIVHRRGYRKGLGGEMCAEFLGTFVLILFGVGSVAVAVAGLPGSGRQTADFGPANWLIISWGWGLAVVFGVYVAGGISGAHLNPAVTLGFAVRRDFPWRKVLPYWLAQVVGAFVAAALVYACYRWAIDAAIAKAGETRETSLNTYSIFATFPAEYFGDSWWGPLLDQIVGTGILLLLICALIDTRNTAPMANLHPYLIGLVVVAIGLTFGTNAGYAINPARDFGPRLFTFFEGWGDIALPGTFQWFSGYWWIPIVGPLIGGVVGVLVYDLLVSPVLKARLTEREEGPATEEPS

SEQ ID NO: 10503 - protein, 405 aa, Medicago truncatula
MESENPKPSSSDSTALINSFIEITSSTKQEALFFLESHNFDLDAAVSSFLDNDTTLPLNDTATLPQNDTVSPSDSLSPDFHPDDSPPSQSPSQSPSRAPYELRSRRSIGKKSGSGSRQSGIRTLRDVKRDQDSDSESDEPQEYYAGGQKSGMLVQDPTRGGNSVDDIFDQAKQVAVEPPAENSSRSRSFTGTARLLSGEAVPSAPQPVESVTHVVTFWRNGFSVNDGPLRRLEDPQNAEFLESIKKSECPKELEPTDRRTSVRLSLTRRDENYPEPVKPRNTAFRGVGRTLGDSSSNGEAASGPSQTTADASPLTAPAPAMGLVVDDSKPVTSIQLRLSDGTRMVSRFNHHHAIRDIRAFIDASRPGGTRSYQLQTMGFPPKQLTDLDQTIEQAGIANSVVIQKQ

SEQ ID NO: 10504 - protein, 400 aa, Pisum sativum
  misc_feature (50)..(51): Xaa can be any naturally occurring amino acid
  misc_feature (123)..(123): Xaa can be any naturally occurring amino acid
  misc_feature (204)..(204): Xaa can be any naturally occurring amino acid
MESENPNSDANAALINSFIEITSSTQQEALFLLESHNFDLDAAVSTFLDXXNTAIPIIPINDNTGNAVSPNESLSPDFQPSESPSRSQSPPPSRALRSRRSLGKKPSGSRQSGIRTLRDVKGXQDLGSGSESDEPQEYYTGGQKSGMLVQDPTRGGHTVDDIFDQARQVAVDAPTENSSRSRSFTGTARLLSGEALPSAPQPVXSITHVVTFWRNGFSVNDGPLRRLEDPQNASFLESIKKSECPKELEPADRQTSVRLNLTRRDENYPEPVKPRNTPFRGVGRTLGDSSSSGEAASEPTQTAASASSFTVPVPTMGLVVDESQPVTSIQLRLADGTRMVSRFNHRHTIRDVRAFIDASRTGGARSYQLQTMGFPPKQLTDLDQTIEHAGIANSVVIQKL

SEQ ID NO: 10505 - protein, 430 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 10506 - protein, 428 aa, Pyrococcus abyssi [sequence omitted]

SEQ ID NO: 10507 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 10508 - protein, 399 aa, Archaeoglobus fulgidus
MIIEDVHYRVVFDSRGNETVECEVVAGEVVAKAMAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 10509 - protein, 434 aa, Desulfovibrio vulgaris (strain Miyazaki) [sequence omitted]

SEQ ID NO: 10510 - protein, 423 aa, Methanocaldococcus jannaschii [sequence omitted]

SEQ ID NO: 10511 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 10512 - protein, 165 aa, Brassica oleracea var. botrytis
APVDVRDLTMDEKRRLSEELQDLPYDKLETVVQIIKKSNPELSQQDDEIELDIDSVDIQTLWELYRFVIGYKEGLSNKKEDQGFGSERDAESVHNSIQEPTTLATGTETSRANESGKAIRMSSPGRQKNNAGGSSSSNSSSSDTGSGSSDSDSDSSSGRGSDTGN

SEQ ID NO: 10513 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 10514 - protein, 354 aa, Schizosaccharomyces pombe
DLDISFHFNTDVTKIDLAEKKIYCGSDEKPTESYTKLILATGGEPNKLPIPGLDSKNVYLLRSIADASKLAAVTTEAGDKKNIVIIGSSFIGLELAVVLKDHNVSVIGMESIPFEKVMGKEVGTALKALHEQNGIAFYLENSIKEVKTSSNDSSKAEHIVLKDGQSIPADVVILAAGVKPNLRYLGNAVSLEKDGGVKVDEHCRVLGAEDVYAVGDIAHAPFAGLPSSGEKSHTRIEHWDVAGNLGRVAADHILFGNKAGYTTKSFTPYFWSAQGKQLRYCGNNAAEGFDDVVIQGSLSDYKFACFFTKGEKVVGVCSIMKDPVVSQCARLFIKDAMPSKSQLKENFDVLSIPL

SEQ ID NO: 10515 - protein, 393 aa, Borrelia burgdorferi
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYSPSVGGFLMEKEDNSLGGILKNPERPSVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 10516 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYTKSASDNIIIQYGGSVNSNNVKELMNEPNIDGALIGGASLKAESFLSIINNVL

SEQ ID NO: 10517 - protein, 452 aa, Listeria monocytogenes
MAKAKRTTKFVCQACGYESAKWMGKCPNCNEWNQMVEALEPSKKSRSAFNHTGEPSKATPITQIASETEKRVETNMPELNRVLGGGVVPGSMVLVGGDPGIGKSTLLLQVSAQLTLTNKKVLYISGEESIKQTKLRAERLQVSGDNLYVYAETNLEAVQETIDFVKPDFVVIDSIQTVYHPDVTSAAGSVSQVRECTATLMRIAKMQNIAIFIVGHVTKEGAIAGPRLLEHMVDTVLYFEGERHHAYRILRAVKNRFGSTNEMGIFEMRDVGLVEVANPSEVFLEERLEGASGSTVVALWKNSPRPCGNTSACFANMFGNAKRMATGIDYNKVSLIMAVLEKRVGLMLQNQDAYLKAAGGVKLDEPAVDLAVAVSVASSYRDKPTRSTDCFIGELGLTGEIRSVARIEQRVQEAAKLGFKRISIPKNNEGNWKIPKDVQVVGVETIGEALPD

SEQ ID NO: 10518 - protein, 167 aa, Erwinia amylovora
RHFADTPEEKNLPILLALIGIWYNNFFGAETEAILPYDQYMHRFAAYFQQGNMESNGKYIDRAGNAVSYQTGPIIWGEPGTNGQHAFYQLIHQGTKLVPCDFIAPAVSHNKLSDHHSKLLSNFFAQTEALAFGKSREAVEQEFADAGKDAKSVEHIVPYKVFEGNRP

SEQ ID NO: 10519 - protein, 167 aa, Pectobacterium carotovorum
QHFATTPAEKNLPVLLALIGIWYNNFFVAETEGILPYDQYMHRFAAYFQQGNMESNGKYVGRNGNPVDYQTGPIIWGEPGANGQHAFYQLIHQGTKLVPCDFIAPAMTHNALSDHHSKLLSNFFAQTEALAFGKSREVVEAEFAAAGKSAKEVEHVAPFKVFEGNRP

SEQ ID NO: 10520 - protein, 167 aa, Pantoea agglomerans
QHFASAPAEQNLPVLLALIGIWYNNFFGAETEAILPYDQYMHRFAAYFQQGNMESNGKYVDRAGHPVDYQTGPIIWGEPGTSGQHAFYQLIHQGTKLVPCDFIAPAITHNALADHHPKLLSNFFAQTEALAFGKSRDVVEKEFTDAGKSAESVAHIVPFKVFEGNRP

SEQ ID NO: 10521 - protein, 167 aa, Klebsiella oxytoca
KHFSTTAPEKNLPVLLALIGIWYNNFFGAETEAILPYDQYMHRFAAYFQQGNMESNGKYVDRNGNAVDYQTGPIIWGEPGTNGQHAFYQLIHQGTKMVPCDFIAPAITQNPLSDHHPKLLSNFFAQTEALAFGKSREVVEQEYRDQGKDPAALEHVVPFKVFEGNRP

SEQ ID NO: 10522 - protein, 167 aa, Photobacterium sp. WH69
KHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRP

SEQ ID NO: 10523 - protein, 167 aa, Serratia marcescens
KHFAETPAEKNLPVLLALIGIWYNNFFGAETEAILPYDQYMHRFAAYFQQGKMESNGKYVDRNGNPVDYQTGPVIWGEPGTNGQHAFYQLIHQGTKLVPCDFIAPAISHNPLGDHHAKLLSNFFAQTEALAFGKSLEVVEAEFAAQGKTPEQVKHVAPFKVFEGNRP

SEQ ID NO: 10524 - protein, 458 aa, Staphylococcus aureus
MNVILEQLKTHTQNKPNDIALHIDDETITYSQLNARITSAVESLQKYSLNPVVAINMKSPVQSIICYLALHRLHKVPMMMEGKWQSTIHRQLIEKYGIKDVIGDTGLMQNIDSPMFIDSTQLQHYPNLLHIGFTSGTTGLPKAYYRDEDSWLASFEVNQMLMLKNENAIAAPGPLSHSLTLYALLFALSSGRTFIGQTTFHPEKLLNQCHKISSYKVAMFLVPTMIKSLLLVYNNEHTIQSFFSSGDKLHSSIFKKIKNQANDINLIEFFGTSETSFISYNLNQQAPVESVGVLFPNVELKTTNHDHNGIGTICIKSNMMFSGYVSEQCINNDEWFVTNDNGYVKEQYLYLTGRQQDMLIIGGQNIYPAHVERLLTQSSSIDEAIIIGIPNERFGQIGVLLYSGDVTLTHKNVKQFLKKKVKRYEIPSMIHHVEKMYYTASGKIAREKMMSMYLRGEL

SEQ ID NO: 10525 - protein, 379 aa, Alternaria citri
MVALTLGIFFTSLAASAVAAPAPAITPAPKPEVVKRASSCTFSGSNGAAEASKSQSSCATMVLSDVAVPSGTTLDLSSLADGTTVIFEGTTTWGYSEWKGPLLDIQGKKITVKGAEGSVLNGDGARWWDGKGGNGGKTKPKFFSAHKLTDSTITGITIKNPPVQVVSINGCDGLTITDMTIDASDGDKDEQGHNTDGFDIGSSNNVIIDGAKVYNQDDCVAVNSGTEITFKNGLCSGGHGLSIGSVGGRDDNTVDTVTFSNSEVTKSVNGVRVKAKVGTTGKINKVTYDDITLSEISKYGVLIEQNYYGGDLHGDADTGVPITALTLDNVTGGVSSSGYDVVVTCGKGSCTGWTWTGVDVTGGKTYDKCSNVPSVTKCS

SEQ ID NO: 10526 - protein, 379 aa, Alternaria alternata
MVALTLGIFFTSLAASAVAAPAPAITPAPKPEVVKRASSCTFSGSNGAAEASKSQSSCATMVLSDVAVPSGTTLDLSSLADGTTVIFEGTTTWGYSEWKGPLLDIQGKKITVKGAEGSVLNGDGARWWDGKGGNGGKTKPKFFSAHKLTDSTITGITIKNPPVQVVSINGCDGLTITDMTIDASDGDKDEQGHNTDGFDIGSSNNVTIDGAKVYNQDDCVAVNSGTEITFKNGLCSGGHGLSIGSVGGRDDNTVDTVTFSNSEVTKSVNGVRVKAKVGTTGKINKVTYEDITLSEISKYGVLIEQNYDGGDLHGDADTGVPITALTLDNVTGGVSSSGYDVVVTCGKGSCTGWTWTGVDVTGGKTYDKCSNVPSVTKCS

SEQ ID NO: 10527 - protein, 323 aa, Aspergillus niger
MTNFKWIVAAAGLLFGQVLAAPTATSTHAKRATVSDAAFGYASLNGGTTGGAGGTTTTVSSYAAFTSAVSGDDAKVVYVDGTIKQTADQVKIGSNTSIIGKDANAILEGFGVLVKEKENVIIRNLGVSKVLADNGDAIGVQYSNNVWIDHCDVSSDRDHDKDYYDGLIDITHGSDYVTVSNTFIHDHWKASLVGHSDSNEDEDSGHLTVTYANNYWYNVNSRAPSFRFGTGHVYNSYYLDVSDGINTRDGAQLLVESNQFVDSKKALYSTDDGYAVSNDNDFGDSENTAEEGTLTSMPYDYTLLGSANVKAAVVGTAGQTLTF

SEQ ID NO: 10528 - protein, 1635 aa, Mycosphaerella graminicola
MATGGSASTPIVGDYNPERVEQLFDIPRPEQGNIYVEAENAARTPSGAQESQLSGSTPGINTADHADDSYLTANGREAAESINDDKKSSGFNSDDDQPINAEERNILRRLATNSRRSMNNTNEDPEALQRTGTLDGLGMDDPVFDPNSPRFDLYKWLKLTLKLVNDEDIKIKRSGLAFKDLHVSGSGSALNLQPTVSSMLSAPLRIGEMFSMAKKPHKQILRSFDGLMKSGELLIVLGRPGSGCSTLLKSLTGQMHGLTMDEKTTIHYNGIDQKQMIKEFQGEVIYNQEVDKHFPHLTVGQTLEHAAALRMSQQRPLGTSRQSAVEYLTQVVMAVYGLSHTYNTKVGNDFVRGVSGGERKRVSIAEMALAGSALAAWDNSTRGLDSATALTFIKALRLNADLVGSAHAVAIYQASQAIYDLFDKAIVLYEGREIFFGKASVAKKYFEDMGFYCPSRQTTGDFLTSVTNPAERQLREGYEDRAPRTGDDFEKYWHDSPEYQTLQKEIQGHTKEGSTPSATSSGTSKLSAASKNDNQAKHARPKSPYVVSVPMQIKLNTKRSWQRIWGDKAQTFTPMIFNVIIALIIGSIFFNSPPATSAFTARGAVLFFAILINALSAISEINSLYDQRPIVEKHKSYAFYHPATEAIAGIVMDVPLKFVVAVCFNLVLYFMSGLRREPAQFFLFFLIAFVSTFVMSAVFRTLAALTKTISQAMALSGVMVLALVIYTGFVVPTKYMKPWFGWIRWINPIFYAFEILVANEFHAREFECSQFIPTYTQFGGETFICSVVGAVAGELTVTGDAYIAEMYGYYYSHVWRNFGILLAFFFAFMVIYFVAVELNSSTFSTAEVLVFRRGHVPAYMQNIDKPGKEDGEAAAAEKGPEKGDEGGDVSAIPPQTDIFTWRDVDYDIEIKGEPRRLLDHVSGWVKPGTLTALMGTSGAGKTTLLDVLAQRTTMGVVTGNMFVNGAPLDDSFQRKTGYVQQQDLHLETSTVRESLRFSAMLRQPRTVSKQEKYEYVEEVIKMLNMEDFAEAVVGVPGEGLNVEQRKLLTIGVELAAKPKLLLFLDEPTSGLDSQSAWAICAFLRKLADAGQAVLCTIHQPSAILFQEFDRLLFLRKGGHTVYFGDIGKNSRTLLDYFESNGARDCGEEENPAEYMLEIVGDDSSDWVGTWNDSKEARRGTAGDRTHSQGTLLRGEELDRRQRRPLRPRRIRHAFRRPTQDGHSPRVPTILAYAELPVRENGSLHRRWSLHRFLLLLRDATLQGMQNVIYSLFMLTTIFSTLVQQIQPLFVTQRSLYEVRERPSKAYSWKAFLIANMVVEIPYQIIAGILVYATFYYPVVGIQSSERQVLVMLLCIVLFVYASTFAHMCIAAMPDAQTAGAIVTFLFFMALIFNGVMQPPSALPGFWIFMYRVSPFTYWVASMASAMLHDRQVTCSDTEISTFQPPQGQTCGQYMQPYLEGGAAGYLQNPDATADCGYCSIRVADTFLSGVGISWSNRWRDFGLVWVYVFFNLGMAVFLYWFFRVRSHSKKTSKKSKKSGDKKGAAAVAGTEKDDKKVKKTDTSSSSEGNTPAAASVDPEKDAEAQRSGSTTSAKAVKRQTSRTAGLTRTVSEMGQSVLTTNKGRSRANERNAHVY

SEQ ID NO: 10529 - protein, 453 aa, Pseudomonas fluorescens
MTRNNPQTREWQALSNDHHLAPFSDFKQLKEKGPRIITHAKGVYLWDSEGNKILDGMAGLWCVAVGYGREELADAASQQMRELPYYNLFFQTAHPPVLELSKAIADIAPEGMNHVFFTGSGSEGNDTMLRMVRHYWAIKGQPNKKVIISRKNGYHGSTVAGASLGGMTYMHEQGDLPIPGIVHIAQPYWFGEGGDMSPEEFGVWAANQLEEKILELGVDNVGAFIAEPIQGAGGVIVPPDSYWPRMKEILAKYDILFVADEVICGFGRTGEWFGTDYYGLKPHMMTIAKGLTSGYIPMGGLIVRDDVVAVLNEGGDFNHGFTYSGHPVAAAVALENIRILRDEKIIERVHAETAPYLQKRLRELNDHPLVGEVRGVGLLGAIELVQDKATKRYEGKGVGMICRQFCFDNGLIMRAVGDTMIIAPPLVISKAEIDELVTKARQCLDLTLSALQG

SEQ ID NO: 10530 - protein, 197 aa, Pennisetum ciliare
MKVKSAVLLCVVLASLLLATQDATYARELTEANGPEGSVKLAGGPGFKDVKWLLGGHKHGGGYGNEGGYGGGYGNNGGYGGGNDPPSYGGGSGPGYGGPGYGTGGRYGGPGFGRSYKHHVHGGGGYGPGYGGGYGPGYGGGNSCPPCGSGNAGPGYGGGYGGGNGGGYGSGSGSGSGNGGGGGGGYGGGYGSSGISP

SEQ ID NO: 10531 - protein, 217 aa, Oryza sativa
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRSVEAGDDAGSGPGKGEKINIKDDVSAVKKGGCCSG

SEQ ID NO: 10532 - protein, 475 aa, Afrocarpus falcatus
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEENQYIVYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFCFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREVTLGFVDLLRDDFIEKDRSRGIYFTQDWVSMPGVIPVASGGIHVWHMPALTEIFGDDSVLQFGGGTLGHPWGNAPGAVANRVALEACVEARNEGRDLAREGNEVIREASKWSPELAAACEVWKEIIFEFETIDTL

SEQ ID NO: 10533 - protein, 465 aa, Quisqualis indica
VGFKAGVKDYKLTYYTPDYQTKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEGIYKAQAETGEIKGHYLNATAGTCEEMIKRAVFARELGAPIVMHDYLTGGFTANTSLAHYCWDNGLLLHIHRAMHAVIDRQKNHGMHFRVLAKALRMSGGDHIHAGTVVGKLEGEREITLGFVDLLRDDYIEKDRSRGIYFTQDWVSLPGVIPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 10534 - protein, 174 aa, Triticum aestivum
MAPAVMASSATTVAPFQGLKSTAGLPVSRRSRGSLGSVSNGGRIRCMQVWPIEGIKKFETLSYLPPLSTEALSKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 10535 - protein, 175 aa, Oryza sativa
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFIRIIGFDNVRQVQLISFIAYKPPGCEESGGN

SEQ ID NO: 10536 - protein, 175 aa, Triticum aestivum
MAPAVMASSATTVAPFQGLKSTAGLPISCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 10537 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 10538 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 10539 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 10540 - protein, 183 aa, Pyrus pyrifolia
MASSMISSGTVATVSADRPAPAQARMVAPFNGLKSSSAFPVTRKSNDITSIASNGGRVQCMQVWPPLGLKKFETLSYLPPLSSESLAKEVDYLLRKNWVPCLEFELETGFVYRENHRSPGYYDGRYWTMWKLPMFGCTDSSQVLKELEEAKKAYPQSFIRIIGFDNVRQVQCISFIAYKPAGF

SEQ ID NO: 10541 - protein, 231 aa, Escherichia coli
MFRKLAAECFGTFCLVFGGCGSAVLPAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRD

SEQ ID NO: 10542 - protein, 302 aa, Antirrhinum majus
MVSSHRSLMEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 10543 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 10544 - protein, 312 aa, Antirrhinum majus
MAEEKSKSSAMDAFVKLEKVGEGTYGKVYRAMEKSTGKIVALKKTRLHEDEEGVPPTTLREVSLLRMLSRDPHVVRLLDVKQGQNKEGKTVLYLVFEYMDTDLKKYIRSFKQTGESIAPMNVKSLMYQLCKGVAFCHGHGVLHRDLKPHNLLMDRKTMMLKIADLGLARAYTLPIKKYTHEILTLWYRAPEVLLGATHYSPAVDMWSVACIFAELVTQKALFPGDSELQQLLHIFRLLGTPNEEIWPGVSTLVDWHEYPQWTAQPISSAVPGLDEKGLNLLSEMLHYEPSRRISAKKAMEHPYFDELDKSGL

SEQ ID NO: 10545 - protein, 297 aa, Mycobacterium smegmatis
MQLGLIGLGKMGFNMRERLREAGHEVIGYDPRPEVSDVANLEELAGALSAPRVVWVMVPSGTITHSTIVELAGVLSPGDLVIDGGNSRYTEDGPHAELLGEKGISFIDAGVSGGIWGLTEGYGLMVGGSDDDVARAMPIFDALRPPGDVADGFVHAGPVGAGHYAKMVHNGIEYGLMHAYAEGYELLAAEELIKDPQAVIQAWSNGTVVRSWLQSLLAKALKEDPGFAEISGYTEDSGEGRWTVEEAIAHRVPMPVIAASLFARFASRQEDSPTMKAVSALRNQFGGHAVKRISESG

SEQ ID NO: 10546 - protein, 474 aa, Synechocystis sp. PCC 6803
MSQDFDYDLVIIGAGVGGHGAALHAVKCGLKTAIIEAKDMGGTCVNRGCIPSKALLAASGRVREMSDQDHLQQLGIQINGVTFTREAIAAHANDLVSKIQSDLTNSLTRLKVDTIRGWGKVSGPQEVTVIGDNETRILKAKEIMLCPGSVPFVPPGIEIDHKTVFTSDEAVKLETLPQWIAIIGSGYIGLEFSDVYTALGCEVTMIEALPDLMPGFDPEIAKIAERVLIKSRDIETYTGVFATKIKAGSPVEIELTDAKTKEVIDTLEVDACLVATGRIPATKNLGLETVGVETDRRGFIEVNDQMQVIKDGKPVPHLWAVGDATGKMMLAHAASGQGVVAVENICGRKTEVDYRAIPAAAFTHPEISYVGLTEAQAKELGEKEGFVVSTAKTYFKGNSKALAEKETDGIAKVVYRQDTGELLGAHIIGIHASDLIQEAAQAIADRKSVRELAFHVHAHPTLSEVLDEAYKRAV

SEQ ID NO: 10547 - protein, 184 aa, Saccharomyces cerevisiae
MLKYLVQRRFTSTFYELFPKTFPKKLPIWTIDQSRLRKEYRQLQAQHHPDMAQQGSEQSSTLNQAYHTLKDPLRRSQYMLKLLRNIDLTQEQTSNEVTTSDPQLLLKVLDIHDELSQMDDEAGVKLLEKQNKERIQDIEAQLGQCYNDKDYAAAVKLTVELKYWYNLAKAFKDWAPGKQLEMNH

SEQ ID NO: 10548 - protein, 445 aa, Saccharomyces cerevisiae
MSKYQINCIRYRHFLRTSNISQIPDFTKYCIGPVNEELAPYIMETMKAYPSNSEYINPQHYYHNRTVLVENYLKRSPNPVSLTQLAQYYDDSTKLTRTKIINSGKFVKEELVIRIAHKLNQLQQLPFNVVNNFHFVQVYESYYNIFESFRKYPTIRTLEDASQFADFIKNMLEGFNTLNLPHLIMGALECTILDLYPREKMDQLLSDLLRARISRRLIVEEHVVYTANYTSGKEENTLVLGDIFQECSAKKYLLEASEESQKFIQDMYFKDIPMPEFIIEGDTQLSFYFLPTHLKYLLGEILRNTYEATMKHYIRKGLEKPEPIIVTVVSNDESYLFRISDKAGGVLHDDENLWSFGKSKERAQESLNNFHKLPGLQTVSIYDEVHSHTKYNSKLKSLQSITLKPYMHTSLEPMSYPSIINGHIKYETPLIELLSGLLDTSLGLG

SEQ ID NO: 10549 - protein, 486 aa, Saccharomyces cerevisiae
MNRILSSASLLSNVSMPRQNKHKITKALCYAIIVASIGSIQFGYHLSELNAPQQVLSCSEFDIPMEGYPYDRTWLGKRGYKQCIPLNDEQIGIVTSVFCIGGILGSYFATSLANIYGRKFSSLINCTLNIVGSLIIFNSNSYRGLIIGRILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 10550 - protein, 347 aa, Saccharomyces cerevisiae
MTTDTTVFVSGATGFIALHIMNDLLKAGYTVIGSGRSQEKNDGLLKKFNNNPKLSMEIVEDIAAPNAFDEVFKKHGKEIKIVLHTASPFHFETTNFEKDLLTPAVNGTKSILEAIKKYAADTVEKVIVTSSTAALVTPTDMNKGDLVITEESWNKDTWDSCQANAVAAYCGSKKFAEKTAWEFLKENKSSVKFTLSTINPGFVFGPQMFADSLKHGINTSSGIVSELIHSKVGGEFYNYCGPFIDVRDVSKAHLVAIEKPECTGQRLVLSEGLFCCQEIVDILNEEFPQLKGKIATGEPATGPSFLEKNSCKFDNSKTKKLLGFQFYNLKDCIVDTAAQMLEVQNEA

SEQ ID NO: 10551 - protein, 465 aa, Saccharomyces cerevisiae
MPIKRLDTVVVNTGSQNDQHSASVPPVYLSTTFKVDLNNEDAQNYDYSRSGNPTRSVLQHQIGKLYRVPQENVLAVSSGMTALDVILRGLVLLNGTDNHTPTIIAGDDLYGGTQRLLNFFKQQSHAVSVHVDTSDFEKFKTVFQSLDKVDCVLLESPTNPLCKVVDIPRILRFVKCISPDTTVVVDNTMMSGLNCNPLQLNPGCDVVYESATKYLNGHHDLMGGVIISKTPEIASKLYFVINSTGAGLSPMDSWLLVRGLKTLGVRLYQQQRNAMILAHWLENSCGFKPTRTNKATKTRFVGLRSNPDFKLHKSFNNGPGAVLSFETGSFEHSKRLVSSKKLSIWAVTVSFGCVNSLLSMPCKMSHASIDPELRKERDFPEDLVRLCCGIENIVDLKKDLLAAMVDADIIEVRENGKYLFNKLNKNLAVNTTIDDLHKPLSIYEEFYNQDLIRKDSELNIKSSKL

SEQ ID NO: 10552 - protein, 222 aa, Saccharomyces cerevisiae
MSNEDYGYDYDYLFKIVLIGDSGVGKSNLLSRFTTDEFNIESKSTIGVEFATRTIEVENKKIKAQIWDTAGQERYRAITSAYYRGAVGALIVYDISKSSSYENCNHWLTELRENADDNVAVGLIGNKSDLAHLRAVPTDEAKNFAMENQMLFTETSALNSDNVDKAFRELIVAIFQMVSKHQVDLSGSGTNNMGSNGAPKGPTISLTPAPKEDKKKKSSNCC

SEQ ID NO: 10553 - protein, 314 aa, Saccharomyces cerevisiae
MFKEEDSLRKGQNVAAWKTLLAGAVSGLLARSITAPMDTIKIRLQLTPANGLKPFGSQVMEVARSMIKNEGIRSFWKGNIPGSLLYVTYGSAQFSSYSLFNRYLTPFGLEARLHSLVVGAFAGITSSIVSYPFDVLRTRLVANNQMHSMSITREVRDIWKLEGLPGFFKGSIASMTTITLTASIMFGTYETIRIYCDENEKTTAAHKKWELATLNHSAGTIGGVIAKIITFPLETIRRRMQFMNSKHLEKFSRHSSVYGSYKGYGFARIGLQILKQEGVSSLYRGILVALSKTIPTTFVSFWGYETAIHYLRMY

SEQ ID NO: 10554 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 10555 - protein, 232 aa, Rickettsia montanensis
MNKIYPSAEAALEGLLYDGMTIMSGGFGLCGIPENLINALLKSNVQNLTVISNNCGVDNFGLGLLLQTKQIKKMISSYVGENKIFEQQYLDKVLELELNPQGTLAERIRAACMGIPAFYTKTGIGTIVEEGKETKEFNGKKYIMETALQAELAIIKGFKADKSGNVIYNKTARNFNAVMAGAAKVTVCEVEEIVEVGELDPNNIHTPNIFIQRLIVGEKYEKRIEQLTVREK

SEQ ID NO: 10556 - protein, 408 aa, Pseudomonas sp. Cam-1
  misc_feature (36)..(36): Xaa can be any naturally occurring amino acid
  misc_feature (51)..(51): Xaa can be any naturally occurring amino acid
  misc_feature (104)..(104): Xaa can be any naturally occurring amino acid
  misc_feature (119)..(119): Xaa can be any naturally occurring amino acid
MIDTIAIIGAGLAGSTAARALRAQGYEGRIHLLGDXSHQAYDRTTLSKTVXAGEQPEPPAILDSAWYASAHVDVQLGRRVSCLDLANRQIQFESGAPLAYDRLXLATGARARRMAIRGXDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRVPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 10557 - protein, 131 aa, Flaveria ramosissima
SNGGRVQCMKVWPPLGKKKYETLSYLPNLTETQLAKEVDYLLRNKWVPCLEFELEHGFVYRENHRSPGYYDGRYWTMWKLPMFGCTDSSQVMKELGECKKEYPQAWIRIIGFDNVRQVQCISFIASKPDGY

SEQ ID NO: 10558 - protein, 131 aa, Flaveria ramosissima
SNGGRVQCMKVWPPLGKKKYETLSYLPDLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 10559 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFISPKPTGF

SEQ ID NO: 10560 - protein, 131 aa, Flaveria palmeri
SNGGRVQCMKVWPPVGKKKYETLSYLPELTEAQLAKEVDYLHRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 10561 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 10562 - protein, 466 aa, Mielichhoferia elongata
RVGFKAGVKDYRLTYYTPEYKTKETDILAAFRMTPQPGVPAEEAGAAVAAESSTGTWTTVWTDGLTSLDRYKGRCYDIEAVPGEDNQYIAYVAYPLDLFEEGSVTNLFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFVAEALYKSQAETGEIKGHYLNATAGTCEEMMKRAQFARELGAPIVMHDYLTGGFTANTSLAHYCRDNGLLLHIHRAMHAVIDRQKNHGMHFRVLAKALRLSGGDHIHSGTVVGKPEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLARQGNEVIREATKWSPELTAACEVWKQIKFEFETIDTI

SEQ ID NO: 10563 - protein, 466 aa, Rhytidiadelphus squarrosus
GVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFPKEDENLNSQPFMPWRERFLFVAEAIYKSQAETGEIKGHYLNATAGTCEEMMKRAQFARELGMPIVMHDYLTGGFTANTTLAHYCRDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELSAACEVWKEIKFEFDTIDTI

SEQ ID NO: 10564 - protein, 465 aa, Drummondia obtusifolia
VGFKAGVKDYRLTYYTPDYQTKETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALYKSQAETGEIKGHYLNATAGTCEEMLKRAQFARELGAPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTV

SEQ ID NO: 10565 - protein, 324 aa, Arthrobacter keyseri
MRLPPTGLGCMSLSHAYGVPPSRDEGLTMLRAALDEGIGMLDTATLYGGGRNEELVGAAIAGRRDEVFLASKCGMASVDGVKVIDGRPDTLRAQVDASLSRLGVDYIDLYYLHRWDKKVPIGDSVGALAEMVAAGKIGAIGLSEVSVGRLREAQAITPIAAVQNEYSLWSRNAELGMLDATREDGVTLVAFSPVARGFLADAIKDPGQLDPKDIRRGMPRFQLEHWGANAALLSSWRELAAEAGCTPAQLALAWLLSRGDHVLPIPGTTSVAHLRENMAAADITVDGALLARAGVLIGTDTISGARYAPASAAEVDAETFEDAA

SEQ ID NO: 10566 - protein, 403 aa, Arthrobacter keyseri
MGSSIGGVRTAQSLRLEGYEGRIVLVGEETELPYDKPPLSKTVLAGTATEASICLLDRDQAQELGIELQLGRAATGIDIAGNLLNLQGQEALHFDNLVIATGASARPSPWGQRPGIHVLRTLDDGRSLRADLAKGGHLAVVGAGFIGAEAAATARALGLEVTVIDPLPIPMSRIFNAEVGQWFGDLHSSNGVKTIFGTGVESIDGEQGSFALRLTNGQNLEAATILVGIGAVPNDAWLASSGLLVDNGLVLDEYCRTVDAPHIYGVGDVARWRHQKHGEDIRIEHWTNAVEQAACVAYNITHPETPRAYTPVEYVWSDQHDWKIQVVGRVGGKAEHVVIGHPEVHGRFAALYTVDGTSLSGAAIVNWPKALLACRRGMGTGITVQELREKLEPMLDPQPLAAS

SEQ ID NO: 10567 - protein, 480 aa, Trachycarpus fortunei
MSPQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCTEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLDKEGK

SEQ ID NO: 10568 - protein, 477 aa, Sabal domingensis
MSPQTETKASAGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGVPIIMHDYLTGGFTANTSLAHYCRDNGLLLHIHRAMHAVIDRQKNHGMHFRVLAKALRMSGGDHIHGGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEIWKEIKFEFEPVDKLDK

SEQ ID NO: 10569 - protein, 480 aa, Salacca zalacca
MSPQTETKASVGFKAGVKDYKLTYYTPDYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCTEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHGGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLDKEKK

SEQ ID NO: 10570 - protein, 477 aa, Socratea exorrhiza
MSPQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEIWKEIKFEFQPVDTLDK

SEQ ID NO: 10571 - protein, 477 aa, Astrocaryum alatum
MSPQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIIMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFEPVDKLDR

SEQ ID NO: 10572 - protein, 294 aa, Populus tremula x Populus tremuloides
MDQYEKVEKIGEGTYGVVYKARDRVTNETIALKKIRLEQEDEGVPSTAIREISLLKEMQHGNIVRLQDVVHSEKRLYLVFEYLDLDLKKHMDSSPEFAKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQKPLFPGDSEIDELFKIFRILGTPNEDTWPGVTSLPDFKSAFPKWPSKDLATVVPTLEKAGVDLLSKMLFLDPTKRITARSALEHEYFKDIGFVP

SEQ ID NO: 10573 - protein, 343 aa, Oryza sativa
QTGVSLRYMMEFGSRPTERNLLLSAQFLQKELPIRIARRALELESLPFGLSRKPAILKVRDWYLDSFRDIRYFPEVRNRNDELAFTQMIKMIKVRHNNVVPTMALGVQQLKNEQYRTRKIPTAFDEIHEFLDRFYMSRIGIRMLIGQHVALHDPDPEPGVIGLINTELSPIQVGQAASEDARSICLREYGSTSSWRLDIYEDPTFTFPYVSSHLHLMNLELVKNSLAWQYRERYMSSDEDVPPVRIIVADGGRTIKVSDEGGGIPRSGLPRIFTYLYSTAKNPPDMDCPSEGVTMAGYGYGLPISRLYARYFGGDLQIISMEGYGTDAYLHLSRLGDSEEPLP

SEQ ID NO: 10574 - protein, 146 aa, Triticum aestivum
MAGRKGGDRKKAVTRSVKAGLQFPVGRIGRYLKKGRYAQRIGSGAPVYLAAVLEYLAAEVLELAGNAAKDNKKTRIIPRHLLLAVRNDQELGRLLAGVTIAHGGVIPTINSVLLPKKSPAAAEKEAKSPKKKTSTKSPKKKVAAKE

SEQ ID NO: 10575 - protein, 246 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 10576 - protein, 190 aa, Klebsiella aerogenes
LQPGESILVHGGASGIGTTAVLLCHALGMTVYATVGQDEKIAALRPYATAINYKTDDFAEKIGQLTNDEGVDVILDIVGGPYFNRNLGLLKKDGRLVIIGFMGGRLAHEVDIQTLMLKRATVTGSTMRGRTAAEKQQIAEALRRHVWPLLEAGKCKPLIYASYPMAEIAEAHACLDSGQHLGKVVITMTS

SEQ ID NO: 10577 - protein, 349 aa, Solanum tuberosum
MAGSNINQPLLDQLPKTLQNVDSRRRRLRRLKSAPMPEFVPGEMNDIKDDQSLPRYESILDKLHPSFRKVILYLAIYLTIGTTCFYFVQNQIQGKKVNGVLDSVYFCVVTMTTVGYGDLVPNSATAKLLASFFVFSGMALVGMVLSKGADYLVEKQETLLIKALHMRDKVGPSVILEEIETNKVRYKCFVITATLVVLIVVGTVFLAEVEKLSTIDAFYCVCSTITTLGYGDKSFSTKAGRIFAIFWILTSTLCLAQFFLYVAEFNTERKQKELVQWVLSRKMTNVDLEVADLDNDRIVGAAEFVVYKLKEMGKISQDDVSLLLDEFECLDVDQSGTLSTTDLSLAQSS

SEQ ID NO: 10578 - protein, 117 aa, Flaveria trinervia
DESWCQGLDGLASRSAAYYQQGARFAKWRTVVSIPNGPSALAVKEAAWGLARYAAISQDNGLVPIVEPEILLDGEHGIDRTFEVAKKVWAEVFFYLAENNVMFEGILLKPSMVTPGA

SEQ ID NO: 10579 - protein, 427 aa, Corynebacterium glutamicum
MRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 10580 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWVNFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 10581 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQSPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 10582 - protein, 233 aa, Spinacia oleracea
CVAQTSEWEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 10583 - protein, 466 aa, Hypoxis leptocarpa
AGFKAGVKDYKLTYYTPDYETKDTDILAAFRVTPQPGVPPEEAGAAVAAESSTGTWTTVWTDGLTSLDRYKGRCYHLEAVVGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLASYCRDNGLLLHIHRAMHAVIDRQKNHGMHFRVLAKALRMSGGDHVHAGTVVGKLEGERELTLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEIIREACKWSPELAAACEVWKAIKFEFAPVDTPD

SEQ ID NO: 10584 - protein, 49 aa, Escherichia coli
DVAVFFGLSGTGKTTLSTDPKRRLIGNDEHGWDDDGVFNFEGGCYAKTI

SEQ ID NO: 10585 - protein, 49 aa, Escherichia coli
DVAVFFGLSGTGKTTLSTDPKRRLIGDDEHGWDDDGVFNFEGSCYAKTI

SEQ ID NO: 10586 - protein, 122 aa, Pisum sativum
TWFHVTCDSNNHVIRLDLGNSNISGSLGPELAQLTHLQYLELYNNNINGNIPQELGNLKNLISMDLYDNQFEGNIPKSFSNLKTLKFLRLNNNKLTGPIPRELTHLKNLKILDVSNNDLCGM

SEQ ID NO: 10587 - protein, 507 aa, Triticum aestivum
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 10588 - protein, 463 aa, Polyangium cellulosum
MPLSLAPEHEARRVEFQGFVDEHVAPFADAFHRAQRTPPELIALLAERGYLGISIPKEFGGAGEDAVTLGLLAAELARGCSSVRSLLTVHTMVALAILRWGTRAQRERWLPELASGRRIGALALSEPGVGSDAKSVTTRIAAQGTDLVIDGEKRWITYGEIADLFLVFGRTEEGPTAVLVERGRPGLRTEPIRDLLGIRASMTASVHLDGCRVEADHVVGRRGLGITQVASVALDLGRYTVAWGCVGILRACVEACVAYTSRREQFGAPLKEHQLVRRMISDMFTDLHASEMLCMEAGRLRDRRDPGALSATAMAKYFASTWIDWGSFEGPVTTAVWMPRILGFFARRGAAKGAPLGTAANSFSHASSPLRPRDRSSTATNSPFRNGSLAPSTVIGAPQRRPAARLLPRQTSTSPRSELIRPRDRRDPSALEVKPPGYWKWRMDHGPGAGVVAVGGSSGFSKS

SEQ ID NO: 10589 - protein, 206 aa, Ureaplasma parvum serovar 3 str. ATCC 700970
MIKNQKTRNDGIKMKDIDPRIKEVLITEEQIDQKITEAANWINKEYEGKEPIIIGILKGCIPFIGKLLPKIKIDMKLDFLAISSFKGATSAQTEPEIITDLKFEVKDRDLILVEDIVDTGRTIKKVYDLLKIRGARSIKLVTLVDKKDGRLVDLQADFVCCDIPLVFIVGFGLDYKEIMRNLPYIGVLKEEVYQNDLNNKNEGDGE

SEQ ID NO: 10590 - protein, 238 aa, Ureaplasma parvum serovar 3 str. ATCC 700970
MKYIIANFKMNATQELINHFLNNLTLFDEQKIIIGLAPGDLYLKTFVNLAEIKKVNLYAQNPSLHNKGPYTGQISCLQLLDINIKNALVGHSEIRIDFSQSIIDQKIKISMDLLEQVIICVGETFDAYKQNKSLNFVLNQLANIINYKGLKKIIIAYEPIWAIGTDLELDFKHINYMIEGIKTYLYNCTGINIPILYGGSVNDNNINELCNQKLIDGFLIGNASLDVNVFNKIIDKCK

SEQ ID NO: 10591 - protein, 502 aa, Ureaplasma parvum serovar 3 str. ATCC 700970
MKLNKKIGLIIIDGLGIGKEDNTNAVHLANPPTLNYLINNFPTLQISAAQQNIGLLENQAGNSEIGHLTIGAGRIILNDNANINNYMKSVDYESAVLSNIKNEIVHIVGMYSNGLVHSNYEHIHWIIKQIIKNNNQVVLHLISDGRDDYPYGFAQFIEQINALKKQYNIIVKSLSGRYFAMDRDQRWERTQKAFNAMFVKQDKICEKTFLEVAQSIANSYKSDEFVQPVVFNDDEKYNLKPHQKVILANYRSDRMRQLAHLLKPNKKFHYNNPFLVQDVNLITLVPFPDVDAIALFEKQNLNNTLGDVFNKHQIKEARIAETEKYAHISFFFDGGVNKYYSTKTQYLIPSQKVATYDLCPQMSAHLITKTIIDHYFDHDVFIVNYANPDMVGHSGNMQQTIEAILSVDHEIRKLYDFFEKNNGVLMITGDHGNAEMMLDDQKQVITSHSVNDVWFIITDNKVILNSTQKFSLANIAPTILEYLNIAQPIQMTATSMIKKICE

SEQ ID NO: 10592 - protein, 440 aa, Ureaplasma parvum serovar 3 str. ATCC 700970 [sequence omitted]

SEQ ID NO: 10593 - protein, 474 aa, Ureaplasma parvum serovar 3 str. ATCC 700970
MFSKTRIIATVGPATTKLFSNWLEFNDLNNINDAQQVCINIKDLILSGVNIFRMNLSHGDQKIHLFRTQLIKKIADELKIKVEILFDTKGPEIRVCEMSDNNFIIKNSEVIIHCKEKVLGSFNEFSVTDATGQYNMISDVKINHRILIDDGKLILIVKKIDFLKNIIYTTAKNSYSLKTNKRLNLPDANYSLPFLSKKDIDDINLAVKLKIPYLALSFISNIKQINEVKQLLKKSSFIPKLIAKIETQEAIDNLEEIIKNTDGIMVARGDLGLEVPFYKIPIYQNKIVELCHKYNKYCIIATQMLDSLERNIIPTRAEVTDVYYAVKQKVNATMLSGETAAGIDPINAVQVMKSIILETENNNIENEITFKKNELLIPKEVKLKILSFHKLKINKHKLLVVNLISKNSKHLVYDILKYDFNFNILFVIDKNQEHDLLLKNANFIISENKMLKQEELLKSFNIDFNNHEFLFISI

SEQ ID NO: 10594 - protein, 213 aa, Ureaplasma parvum serovar 3 str. ATCC 700970
MKILLIGPPGSGKGSVSELLTKNNTLKHVSTGNLFRAILKEDSELARKIKEINVSGGKLVPDEITNQVAKSAIDELIKNEQSFILDGYPRTINQALALEQYCNLDYIFYLDIDHQELMKRLTGRWMCPKCAGIYNIHFKKPQVHGLCDNDQATLYQRADDHADAVSIRLDEYDKLTLPLIKHYETNPRFIKINANQPIEDVYKNINNYLKQNK

SEQ ID NO: 10595 - protein, 422 aa, Ureaplasma parvum serovar 3 str. ATCC 700970
MNSLNKKSIKDLDVNGKTIVLHLDLNVVVDYENKRILNDRKLRASLPTINYLINHNAKIVILSHLGRIKTLADKQSGKYSLEIIVDELRNRVSKNVNRVVFSPLNYGETVVQMVNDLEERDILILENTRYCDISDEGEYVGLEWDGSEILGQFWGMLGDIFIDDAYGVAHRQLSSNYQTAKFAKKSALGFLIVNEINHLDIALEVPKSPYLALIGGNRVADKIAAIEVLCERADQVIIGGGLVYTFLYAQGYNVGLNLVERNMIDDCNNILEKYGKKILICFDFLCNNDFSDTRPIYRKIDEGLEGLYGLDIGKRSLKFIKHEIYRSKTILLNGPFGVIENIKNYAQGTTEICKSMAKQTTRGAYTIICDIDTSSHAEYLGLDKYINFISTGGGASLSYIEEGVLDGLETIDNVPLNVLKKE

SEQ ID NO: 10596 - protein, 162 aa, Ureaplasma parvum serovar 3 str. ATCC 700970
MERLNMKLSDYPVLDIDKKLFNWSKVKNKLVLIVNVASKCGYAKQYEQLEYLYKKYKNKGFIIVAFPCRQFMFQEFDDNNKIKEFCSTKYNVTFPIMDLTNVVGSNISPLYKQLITEYPWSPKAKAVKWNFEKFFVKNDEIIGRFESKCEPNDLEEFIKNNL

SEQ ID NO: 10597 - protein, 475 aa, Ureaplasma parvum serovar 3 str. ATCC 700970
MNYKTLINGAFVDAKEKLPVYNPSNNQIIAYVPNIHNENEINTIFENAHIAYLKFKDTPIKYRCDLLLKLADKLDEHKQELAQIISTEIAKGLKDSLIEVERSADYLRETVFEYQKLMQKPIIFDETVHHVKNKVATYYRIPVGVVLAICPFNYPINLLISKLAPALVSGNSLVYKPSTQGSLIGIRISELVHEVGFPKGVVNCLTTEARITGDLLVTNKYVKAISFTGGPKVGNHIAEITSKISLVLELGGKDPALVLDDADFELAANEIVKGAYGFSGQRCTAIKRVFVSHKNHDLLVNLINKKVDALTVGLPQQNPIITPLINSNSLKYNLSLVEDAIKKGAIVHQKIVYNEKNNLLHPLVIDNVTKEMRVAWEEPFGPILPIITYNSIQEAIDLINQSQYGLQACIFTTNYASIEQLALQIESGTININKSSSRGPDILPFFGVKDSGFGVQGIVDAILSMTTIKGIIINK

SEQ ID NO: 10598 - protein, 375 aa, Ureaplasma parvum serovar 3 str. ATCC 700970
MAKRDYYEILGVSKSATPEEIKAAFRKLAKEHHPDRNKSADDTLFKEINEAYEVLSDSKKRAQYDQFGHDGPQGFSSASGFSGFSGGFGGVDFDINDIFGSFFNNASSSHNSSNQYETYDIHLRLHLDFMEAVNGISKNINYDRKITCHKCQGTGAKDPKDVKICTKCHGRGTSIENVHSLFGTIQQEVECHECEGTGKVASSKCEQCYGKKVINERVNLTVEIPAGTREGEKLLVSKKGNIVNNQEFDLYLHISVKPSKYFALDGLDIYSETYIDPIKAIVGGIIEVVTINGIKTIEIPSNTPEGKKFRISGSGIVNKKSNIFGKKNGDFYTTIRYAKPVELSKDEIAYLKNISTRTNQNVEYYKNKVLKEISK

SEQ ID NO: 10599 - protein, 219 aa, Ureaplasma parvum serovar 3 str. ATCC 700970
MNKQLVPSLLAFDKKYPYEQLKIFKKHHLQTIHYDVMDLTYVNNTAFETEHLEWLLKNDFLVHIHLMVINPLEKIKQYFIYKPTRISFHFEMNDYQTNLLIINEIKKHHVLAGIAIHPCLSLNDYASYLKEVDYITFMSVIPGKGGQIFLEESLLKLKKLYEYKIKNNFKFKIEIDGGITLEVIKKINIPIDFFVSGSYLVKNIEKLEQTVNEFNQLVN

SEQ ID NO: 10600 - protein, 450 aa, Acinetobacter sp. M-1
MTKHYDYIAIGGGSGGIASVNRAAMYGKKCALIEKSEIGGTCVNVGCVPKKVMWYAAHVAESIQKYGPDYGFNTKVEVFDWQVLIKNRQAYIDRIHQSYQNSLSKNNVDLIQGAAYFIDQHTIEVNGERFTADHILIATGTQPSLPKIDGVEYGIDSNGFFELSALPKTTAVIGSGYIAVELAGVLNALGSQVGLFIRKDLPVRRFDSFLSETLVEVMQTDGITVHTQAVPLKVTKNADGSVVLHLENGERHTVDCLIWATGREPNTASLNLEKTNVQLDERGYIQVDKFQNTSQQGIYAVGDIIGKMELTPVAVAAGRRLSERLFNHKSDEHLDYDNIPTVVFSHPPIGTVGITEQEAIEKYGQKEVKVYNSSFTAMYSAITQHRQPTKMKLVCVGENEKIVGIHGIGFGMDEILQGFAVALKMGATKKDFDNTVAIHPTSAEEFVTMR

SEQ ID NO: 10601 - protein, 393 aa, Acinetobacter sp. M-1
MHPIVIIGSGMAGYTVAREFRKLSPEQELVMICADDAVNYAKPTLSNAFAGNKAPEQIALGDATKMATQLNMRIDADTWVKAINAENHELTLEKNGQTITQPYSKLVLAVGANPIRLAIAGDGSDDIHVVNSLVDYRIFRENLANRKDKRVVILGAGLIGCEFANDLLHSQYDVTVIDLAPQPLGRLLPNHVAEAFKTNLEQAGIKFALSTTVEKVTKINNGEDYEVTLANGKTLVADIVLSAIGLQPNISLAKAADIQTSRGIITNTLLETNQADIYAVGDCAEVNGTLLPYVMPIMQQARALAKTLSGQSTAVHYPAMPVAVKTPAAPLTVLPAPLNVDVNWETEEFDDGMLAKAADGEGTLRGFVLLGPTAGKQRLTLTKLVPDLIPAQV

SEQ ID NO: 10602 - protein, 475 aa, Lotus corniculatus var. japonicus
MSPQTETKASVGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPNAYVKTFQGPPHGIQVERDKLNKYGRPLLGCTIKPKLGLSAKNYGRAVYECLRGGLDFTKDDENVNSQPFMRWRDRFLFCAEALFKAQEETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFQAMDTL

SEQ ID NO: 10603 - protein, 126 aa, Lotus corniculatus var. japonicus
MSAQSEGNYAEALQNYYEAMRLEVDPYDRSYILYNIGLIHTSNGEHTKALEYYFRALERNPFLPQAFNNMAVICHYRGEQAIRQGDSEIAESWFDQAAEYWKQAIALTPGNYIEAQNWLKITRRFE

SEQ ID NO: 10604 - protein, 284 aa, Pisum sativum
MKALNGLLGLRRRKIHGLFNGLCAMVVFFFFYNREDIIRNPLLRQSAYLVNHHGLPQNSILKDGVSVIHRRMGEISANTSSVAAENDLGVIKPGLCVGLLHHDGYDSPCEFLKVNPQCTSEGYIDYLRFFFCKCQSFRVLGYLVLGVWLAALFYLLGNTAADYFCPSLEHLSELLKLPPTVAGVVLLPLGNGAPDVFASIASFVGTDTVKLVLTCIAVPCLLQCCCCVVPFVFQQGGQIDQRFFVGACISFLNWRNDMMCIRACKLASGKRLIGSHKVEDYQKV

SEQ ID NO: 10605 - protein, 490 aa, Escherichia coli O157:H7
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGYGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 10606 - protein, 352 aa, Escherichia coli O157:H7
MERTMSQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVSRSEVKQRVKEALAMVDLEGFEDRYVDQISGGQQQRVALARALILKPKVLLFDEPLSNLDANLRRSMRDKIRELQKQFNITSLYVTHDQSEAFAVSDTVLVMNKGHIMQIGSPQDLYRQPASRFMASFMGDANLFPANFSEEYVDIYGYRLPRAAHFPVQGSGTVGVRPEAITLSNHGEESQRCVIRHVAYMGPQYEVTVEWHGQEILLQVNATRLQPDIGEHYYLEIHPYGMFVLADAA

SEQ ID NO: 10607 - protein, 1320 aa, Escherichia coli O157:H7
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLQPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSTVSERIQLAKAENITAQPFDAVIFHGDSDQLRALCEAVAARDGAIVSVQGFARGESNILLERLYIERSLSVNTAAAGGNASLMTIG

SEQ ID NO: 10608 - protein, 501 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLAFKARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 10609 - protein, 479 aa, Escherichia coli O157:H7
MISGRHDRKPYYAGEAAIMAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVAMSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYEGDRTPVSET

SEQ ID NO: 10610 - protein, 286 aa, Escherichia coli O157:H7
MSSNTFTLGTKSVNRLGYGAMQLAGPGVFGPPRDRHVAITVLREALALGVNHIDTSDFYGPHVTNQIIREALYPYSDDLTIVTKIGARRGEDASWLPAFSPAELQKAVHDNLRNLGLDVLDVVNLRVMMGDGHGPAEGSIEASLTVLAEMQQQGLVKHIGLSNVTPTQVAEARKIAEIVCVQNEYNIAHRADDAMIEALARDGIAYVPFFPLGGFTPLQSSTLSDVAASLGATPMQVALAWLLQRSPNILLIPGTSSVAHLRENMAAEKLHLSEKVLSTLDGISRE

SEQ ID NO: 10611 - protein, 480 aa, Escherichia coli O157:H7
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGINYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 10612 - protein, 119 aa, Escherichia coli O157:H7
MPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 10613 - protein, 198 aa, Escherichia coli O157:H7
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNANWKSWRRESKHKAFARMSFRLAVLMLLAR

SEQ ID NO: 10614 - protein, 452 aa, Escherichia coli O157:H7
MTQRRDLQALIDAAPVGKMQWRVIICCFLVVMLDGFDTAAIGFIAPDIRTHWQLTAGDLAPLFGAGLLGLTAGALLCGPLSDRFGRKRVIELCVFLFGALSLASAFSPDLQTLVFLRFLTGLGLGGAMPNTITMTSEYLPARRRGALVTLMFCGFTLGSAFGGIVSAQLVPVIGWHGILVLGGVLPLMLFVALLVVLPESPRWQVRRQLPQAVIAKTVSAITRERYVDTHFYLIESASVTKGSIRQLFMGRQLPITLMLWVVFFMSLLIIYLLSSWMPTLLNHRGIDLQHASWVTAAFQIGGTLGALALGVLMDKFNPFRVLTLSYAIGAICIVMIGLSQDGLWLMALAIFGTGIGISGSQVGLNALTATLYPTQSRATGVSWSNAIGRCGAIVGSLSGGVMMAMNFSFDTLFFIIAVPAAISAVMLTLLITVVRQSTSVPDSLPRAGVVNE

SEQ ID NO: 10615 - protein, 489 aa, Escherichia coli O157:H7
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 10616 - protein, 304 aa, Escherichia coli O157:H7
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 10617 - protein, 426 aa, Escherichia coli O157:H7
MSSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFAEAKQ

SEQ ID NO: 10618 - protein, 466 aa, Escherichia coli O157:H7
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 10619 - protein, 479 aa, Escherichia coli O157:H7
MIVKKLTLPKDFLWGGAVAAHQVEGGWNKGGKGPSICDVLTGGAHGVPREITKEVLPGKYYPNHEAVDFYGHYKEDIKLFAEMGFKCFRTSIAWTRIFPKGDEAQPNEEGLKFYDSLFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINLEMKVGCMLAMVPLYPYSCNPDDVMFAQESMRERYVFTDVQLRGYYPSYVLNEWERRGFNIKMEDSDLDVLREGTCDYLGFSYYMTNAVKAEGGTGDAISGFEGSVPNPYVKASDWGWQIDPVGLRYALCELYERYQKPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGENL

SEQ ID NO: 10620 - protein, 346 aa, Escherichia coli O157:H7
MVWLANPERYGQMQYRYCGKSGLRLPALSLGLWHNFGHVNALESQRAILRKAFDLGITHFDLANNYGPPPGSAEENFGRLLREDFAAYRDELIISTKAGYDMWPGPYGSGGSRKYLLASLDQSLKRMGLEYVDIFYSHRVDENTPMEETASALAHAVQSGKALYVGISSYSPERTQKMVELLHEWKIPLLIHQPSYNLLNRWVDKSGLLDTLQNNGVGCIAFTPLAQGLLTGKYLNGIPEDSRMHREGNKVRGLTPKMLTEANLNSLRLLNEMAQQRGQSMAQMALSWLLKDERVTSVLVGASRAEQLEENVQALNNLTFSTEELAQIDQHIADGELNLWQASSDK

SEQ ID NO: 10621 - protein, 450 aa, Escherichia coli O157:H7
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 10622 - protein, 141 aa, Escherichia coli O157:H7
MAGAFIGTSSVTAYIESTSGVAVGGRTGLTAVVVGVMFLLVMFFSPLVAMVPPYATAGALIFVGVLMTSSLARVNWDDFTESVPAFVTTVMMPFTFSITEGIALGFMSYCIMKVCTGRWRDLNLCVVVVAALFALKIILVD

SEQ ID NO: 10623 - protein, 1016 aa, Escherichia coli O157:H7
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQENYWGNYPKFFVSMMKAFFGDKATAENSWGFDWLPKWDKGYDVLQYFEMMKEGKVNGYICQGFNPVASFPNKNKVISCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPKSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 10624 - protein, 460 aa, Escherichia coli O157:H7
MAKAPKRAFVCNECGADYPRWQGQCSACHAWNTITEVRLAASPTVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 10625 - protein, 475 aa, Fagopyrum sp. C97107
MSPQTETKASVGFKAGVKEYKLTYYTPDYEPHDHDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIFKSQVETGEIKGHYLNATAGTCEEMIKRAVFARELGVPIVMHDYLTGGFTANTSLAHYCRDNGLLLHIHRAMHAVIDRQKNHGIHFRVLAKALRLSGGDHIHSGTVVGKLEGERDITLGFVDLLRDDFVEKDRSRGIYFTQPWVSLPGVIPVASGGIHVWHMPALTEIFGDDSVLQFGGGTLGHPWGNAPGAVANRVALEACVQARNEGRDLAREGNDIIRKAAKWSPELAAACEVWKEIKFEFQAMDTL

SEQ ID NO: 10626 - protein, 460 aa, Kurthia sp. 538-KA26
MNSHDLEKWDKEYVWHPFTQMKTYRESKPLIIERGEGSYLFDIEGNRYLDGYASLWVNVHGHNEPELNNALIEQVEKVAHSTLLGSANVPSILLAKKLAEITPGHLSKVFYSDTGSAAVEISLKVAYQYWKNIDPVKYQHKNKFVSLNEAYHGDTVGAVSVGGMDLFHRIFKPLLFERIPTPSPYTYRMAKHGDQEAVKNYCIDELEKLLQDQAEEIAGLIIEPLVQGAAGIITHPPGFLKAVEQLCKKYNILLICDEVAVGFGRTGTLFACEQEDVVPDIMCIGKGITGGYMPLAATIMNEQIFNSFLGEPDEHKTFYHGHTYTGNQLACALALKNIELIERRDLVKDIQKKSKQLSEKLQSLYELPIVGDIRQRGLMIGIEIVKDRQTKEPFTIQENIVSSIIQNARENGLIIRELGPVITMMPILSMSEKELNTMVETVYRSIQDVSVHNGLIPAAN

SEQ ID NO: 10627 - protein, 464 aa, Fusarium oxysporum f. sp. radicis-lycopersici
MKVSSFFSTLSLFAGVLAEAIDLPAGVPRSIEEFRAKHPYELPVKRSHRKVYTIRHSKNDNDDVSSEFYKGLKKANKGGTLYLPKGQTFVIGKPLDLTFLNDIHVHLEGEIKFTNDTEYWQKNVYKHPFQNSIMFWKWGGKNIKLYGKGVLNGNGQRWWNEFAGKEILDTTNAYLRPILFYAQNATNLDIQGVHFKDSPCWTNFVVTSKDISFKDVICTARSTNATALPKNTDFFDSLNVENLNVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGKYGNAVAKLTCSTSKDAVCENIKFKDFNIKTPCGGDPVFLCDGVKDIGVDCVSATSTAGKAALANKCVAPQASASPFKVRKFNG

SEQ ID NO: 10628 - protein, 426 aa, Rhizobium leguminosarum
MNATSLTDRKNAAISRGVGMTTQIYADRAENAEIWDKEGRRYIDFAAGIAVLNTGHRHPRVIAAVKDQLDRFTHTCHQVVPYESYVHLAERLNALLPGDFEKKTIFVTTGAEAVENAVKIARAATGRSAVIAFGGGFHGRTFMGMALTGKVVPYKVGFGAMPGDVFHIPFPVELHGVTADQSLAALKKLFAADVDPQRVAAIIIEPVQGEGGFYSAPAAFMKALRELCDQHGILLIADEVQTGFARTGRMFAMDHHEVAPDLTTMAKSLAGGFPLAAVTGRAAIMDAPGPGGLGGTYGGNPLGIAAAHAVLDVIVDEDLCNRANLLGGRLKQRLESMRETVPEIVDIRGPGFMNAVEFNDRTTGLPSAEFANRVRLIALDKGLILLTCGVHGNVIRFLAPITIQDEIFGEALDILEASMLQASAAK

SEQ ID NO: 10629 - protein, 213 aa, Xanthomonas oryzae pv. oryzae
DNTFASPMLQRPLSLGADLVVHSATKYLNGHSDMVGGIAVVGDNAELAEQMAFLQNSIGGVQGPFDSFLALRGLKTLPLRMRAHCENALALAQWLETHPAIEKVIYPGLASHPQHVLAKRQMSGFGGIVSIVLKGGFDAAKRFCEKTELFTLAESLGGVESLVNHPAVMTHASIPVARREQLGISDALVRLSVGIEDLGDLRGDLERALVNQN

SEQ ID NO: 10630 - protein, 443 aa, Pichia pastoris
MPSHFDTLQLHAGQTEAPHNARAVPIYATSSYVFRDSEHGAKLFGLEEPGYIYSRLMNPTQNVFEERIAALEGGAAALAVGSGQAAQFLAIAGLAHTGDNVISTSFLYGGTYNQFKVALKRLGIESRFVHGDDPAEFERLIDDKTKAIYVESIGNPKYNIPDFEALAGLAHKHGIPLVVDNTFGAGGYYVRPIELGADTVTHSTTKCINGHGNTIGGVVVDSGKFPWKDYPEKYPQFSKPSEGYHGLILNDAFGPAAFIGHLRTELLRDLGPASSPFGNFLNIIGLETLSLRAERHAENALKLAKYLETSPYVSWVSYPGLESHDYHEAAKKYLKNGFGGVLSFGVKDHGKPALTPFEEAGPKVVDSLKVFSNLANVGDSKSLIIAPYYSTHQQLSHEEKLASGVTKDSIRVSVGTEFIDDLIRDLEQAFAFVYEERNTKFVS

SEQ ID NO: 10631 - protein, 492 aa, Leptolyngbya boryana
MGKPTGFIEYLRELPSELAPLDRIRNWDEFHLSMPEENLRTQGARCMDCGIPFCHTGTLISGMASGCPINNLIPEWNDLIYRGLWKEALDRLHKTNNFPEFTGRVCPAPCEGSCVLGIHNPPVTIKNIEYSIAEKGWNEGWIKPEPPAKRTGKKIAIVGSGPAGLSAAAQLNKVGHWVTVFERADRPGGLLMYGIPNMKLDKQEVVMRRLNILEAEGVKFVCNTEIGKDLPAEDLLRDFDAVVLCTGATKPRDLPIEGRQLKGIHFAMDFLTANTQAVLDQTEPAITAQGKDVVIIGGGDTGTDCVGTSIRHGCNGLVQLEILPQPPEERAPNNPWPEYPKVYKMDYGQEEAAAKFGGDPRAYLRTATHFEGDEQGNVKAVHTVEVQWERNEQGQFIPKQIPGTEKIIPAQLVLLAMGFLGPEQPLLDAMGLDRDARSNIKSEYGRYTTSIPKVFAAGDCRRGQSLVVWAFNEGRGAARECDLYLMGETNLP

SEQ ID NO: 10632 - protein, 455 aa, Mycobacterium tuberculosis
MSAVALPRVSGGHDEHGHLEEFRTDPIGLMQRVRDECGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPACVRYRRRTGVHHHH

SEQ ID NO: 10633 - protein, 458 aa, Geobacillus stearothermophilus
MSGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 10634 - protein, 221 aa, Castanea sativa
DEARYFFQQLISGVCYCHSMQICHRNLKLENTLLDGSPAPRLKICDFGYSKSSLLHSRPKPTVGTPAYIAPEVLSRREYDGKMADVWSCGVTLYVMLVGAYPFEDPADPKNFRKTINRIMAVQYKIPDYVHISQECRHLLSRIFVASSLKEGITIKEIKSHPWFLKTLPRELTEPAQQCTTRKENPSFSLQEFRIYKNGEEAKFLPTSKRGGFGWGGKKKG

SEQ ID NO: 10635 - protein, 352 aa, Neurospora crassa
MSSAQRGGARKISFNVSEQYDIQDVVGEGAYGVVCSAVHKPSGQKVAIKKITPFDHSMFCLRTLREMKLLRYFNHENIISILDIQKPRSYETFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSELALDLLEKLLAFNPVKRITVEEALKHPYLEPYHDPDDEPTAPPIPEEFFDFDKHKDNLSKEQLKQLIYQEIMR

SEQ ID NO: 10636 - protein, 200 aa, Aspergillus fumigatus
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCQGLPIILVGCKKDLRHDPKTIEELHKTSQKPVTPEQIIDIFVQGEEVRKKIGAYKYLECSARTNEGVREVFEAATRAALLTKTHKKKGKCTIL

SEQ ID NO: 10637 - protein, 197 aa, Aspergillus fumigatus
MELCGRQKVVQRKMVLLGDGACGKTSALNVFTRGFFPTVYEPTVFENYVHDIFVDNVHMELSLWDTAGQEEFDRLRALSYEDTHVIMLCFSVDSPDSFENVATKWIDEIRENCPGVKLVLTALKCDLRKDDELNDNPNAITFEQGLAKAKEIGAVKYLECSAVQNRGIRETFYEAAKVALDVKPAGSSGSKGQCIIL

SEQ ID NO: 10638 - protein, 198 aa, Aspergillus fumigatus
MASGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWYPEIEHHAPNVPIILVGTKLDLRDDPATAESLRQKKMDLSRTRHWPSPKEIRAHKYLECSALRQRNFKSVFDEAIRAVLNPGPAAKPKSKKCTIL

SEQ ID NO: 10639 - protein, 154 aa, Cicer arietinum
ILGLLAMVLLISFEVSARDLTETSSNTEKEVAEQKNEVNDVKYGGGNYGNGGGNYGQGGGNYGNGGGNYGHGGGNYGNGGGNYGHGGGNYGNGGGNYGHGGGNYGHGGGNYGNGGHGGHGGGYCGNGCCGGYYSGSCRRCCSYVGEAIDVNTLN

SEQ ID NO: 10640 - protein, 504 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPLA

SEQ ID NO: 10641 - protein, 500 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFT

SEQ ID NO: 10642 - protein, 501 aa, Botryotinia fuckeliana
PLAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTR

SEQ ID NO: 10643 - protein, 498 aa, Botryotinia fuckeliana
ISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPL

SEQ ID NO: 10644 - protein, 494 aa, Botryotinia fuckeliana
ISQRTTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLF

SEQ ID NO: 10645 - protein, 502 aa, Botryotinia fuckeliana
PLAQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRP

SEQ ID NO: 10646 - protein, 348 aa, Mycobacterium smegmatis
MSTVSAYAATSATEPLTKTTITRRAVGPHDVAFDIHFAGICHSDIHTVKAEWGVPNYPVVPGHEIAGVVTEVGSEVTKYKVGDRVGVGCFVDSCRECDNCKAGLEQYCTGTGMVGTYNAIDRDGTPTHGGYSGAIVVDENYVRIPDSLSLDAAAPLLCAGITTYSPLRHWNAGPGKKVAVIGLGGLGHVAVKLAKAMGADVTVLSQSLKKMEDGLRLGRSAYYATSDPETFDKLAGSFDLILNTVSANLDLGAYLGLLKLDGALVELGLPEHPMEVPAFPLLAQRRNLTGSMIGGIPETQEMLDFCAEHDVRPEIEIITPDYINEAYERVLASDVRYRFVIDTASLRS

SEQ ID NO: 10647 - protein, 491 aa, Pseudomonas putida
MKHYRNYVNGKWTESSRTFDDVSPVDGSLVAIVHEASRELVDEAVKSGHQALSGEWGRTTATQRVALLRRIADEMERRQGDFLAAEMADTGKPHSMASSIDVPRGIANFRTFADILATAPVDSHRLDLADGAYALNYSARKPLGVVGVISPWNLPLLLMTWKVAPALACGNTVVVKPSEDTPGTATLLAEVMEAAGVPPGVFNLVHGFGPNSAGEFISSHPDISAITFTGESRTGTTIMRAAAEGVKPVSFELGGKNAAIIFADCDFDKMLDTMMRALFLNSGQVCLCSERVYVERPLYDRFCAALVERIKGMKIDWPQDPATQMGPLISAKHRDKVLGYFELARTEGATFLAGGGVPHFGDSRDDGAWVQPTVITGLGDDARSVREEIFGPICHVSVFDNEQEVIARANDTRYGLAATIWTSNLGRAHRVSEAMRVGISWVNTWFLRDLRTPFGGAGLSGIGREGGMHSLNFYSELTNVCIRIDEEVADV

SEQ ID NO: 10648 - protein, 465 aa, Akebia trifoliata
VGFKAGVKDYKLTYYTPDYITNDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 10649 - protein, 465 aa, Archakebia apetala
VGFKAGVKDYKLTYYTPDYITKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 10650 - protein, 1790 aa, Emericella nidulans
MPTSDKSRQTSAGKSFFGRKLHKERPVEDRWDAHGSWESLAPPSSAAGSRSSRYSKRSSIQSVDFGADIDPSLLSTSAGPITSIPFESLSTDTQSPIPVDYLSKAETSPRKEPSPGHLAKGVGDFHQYPAWDPSAMRNHQQFSHPTGPRPPPHAAGVAMSSSATGDKGARYQQWGRPGSSAGNAGLSHHSSSTVDSSTNSRMSIDQASIHSSLSSNTRGSSYISTDGSSRTTLPSHSNDRSNYYAAMNSGRGSSAQGAIPPAQPRVQNTEQYLTRPRDDRVVDQLFLELMQKRGWQNLPEQARRQMMAYPASKKWTLVHQDRLTELQGEQKRKQKARETHGYDGPSGILERADEEGSPEWYVKKVMDDTITSKQLASLSVSLRTQPISWVKAFVEAQGQIALTNVLVKINRKKVTGPVPAPPSGDKDLDREYDIVKCLKALMNNKYGADDALAHQQIIVALISSLLSPRLNTRKLVSEVLTFLCHWAEGQGHERVLQAMDHVKNHQGETGRFDAWMRIVEVTIDGRGKMGSLVGASEEYRSGGIGMENLLMEYAVSTMILINMLVDAPENDLQLRCHIRAQFISCGIKRLLSKMEGFQYEVIDKQIEHFRENEAIDYEDLLQRESSSTKDSIEGEVKDMTDPLQITDAIASRLNGTRAHDYFLSALQHLLLIRENSGEDGLRMYQLVDAMLSYVAMDRRLPDLDLRQGLTFTVQSLLDRLHTDAEARRAYDESLEARQIAEAALAERDEMKAQVELGADGLVRKLQKQIEEQTGIIELQSRQNEMLKAELADVQRLRAQELQRNELETRELYLMLRDAQDIAASNAKKSNMGEAETDPAHMRGILDREKLLTRLEKQLERTKTQFKLEGKVWGQHDPSDRLRELREQMDGDAGPREAFEEQARLNLSLNPVGSVYRKKTYIQGMEDTATEELGQTDDEVVYAKARLVDLHRPRMDPEQATGLLGEIAAKVPKIDADDAKDEGKPTESEQPAEGAATKGDEQGVDDTVAVDKATAAPPPPPPPPPAHPGLSGAAPPPPPPPPPPPPGAGAAPPPPPPPPPPPPGGLGGPPPPPPPPPPGGFGGPPPPPPPPGGFGGPPPPPPPPPGGAFGVPPPPPPPGTVIGGWRANYLASQGAPSHAIPVMSSIRPKKKLKALHWDKVDTPQVTVWATHGTTPQEKEEKYVELAKRGVLDEVERLFMAKETRIFGGGVAAKQRKDKKQIISNDLSKNFQIALSKFSQFPAEEVVRRIIHCDAEILDNMVVMEFLQRDEMCTVPENVSKLMAPYSKDWTGPDAANTEREQDPSELTREDQIYLYTAFELNHYWKARMRALALTRSFEPDYEHISAKLREVVRVSESLRDSVSLMNVLGLILDIGNFMNDANKQAQGFKLSSLARLGMVKDDKNETTFADLVERIVRNQYPEWEDFTEQISGVIGLQKLNVDQLRTDAKKYIDNIKNVQASLDAGNLSDPKKFHPQDRVSQITQRSMKDARRKAEQMQLYLEEMVKTYDDIMVFYGEDNTDDGARRDFFAKLAAFLQEWKKSKEKNIALEEARRRTEASLARKRINVGLANGAGAAGDAPVSPATSGAMDSLLEKLRAAAPQAKDQRDRRRRARLKERHQVRVASGQKIPDLEGAEAPGSGGQNSGATDTNATDSSLLSPTIQEPEGGSSPIASQSEDVADRAASMLQDMLRNSPDPERTRRRRESAEEERRKRRLRRRNGATSGSKDSNDTTPLSPVTEPTSTQGESAEPENLSLSSPPNGEDPTLNPPTIVLSSDASDTPDDEHRPSTS

SEQ ID NO: 10651 - protein, 170 aa, Zea mays
  misc_feature (162)..(162): Xaa can be any naturally occurring amino acid
MPRSRINGNFIDKTFSIVANILLQIIPTTSGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLXITKRFEFE

SEQ ID NO: 10652 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 10653 - protein, 169 aa, Pseudomonas syringae pv. syringae
MTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDDGMEGARDLAERMQAEGRGKVLDQFANGDNPEAHYTSTGPEIWRQTGGT

SEQ ID NO: 10654 - protein, 166 aa, Sinapis alba
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 10655 - protein, 169 aa, Sinapis alba
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 10656 - protein, 363 aa, Aspergillus parasiticus
MQLLQSSVIAATVGAALVAAAPVELEARDSCTFTSAADAKSGKTSCSTITLSNIEVPAGETLDLTGLNDGTTVIFSGETTFGYKEWEGPLISVSGTNIKVQQASGAKIDGDGSRWWDGEGGNGGKTKPKFFYAHKLDSSSITGLQIYNTPVQGFSIQSDNLNITDVTIDNSAGTAEGHNTDAFDIGSSTYINIDGATVYNQDDCLAINSGSHITFTNGYCDGGHGLSIGSVGGRSDNTVEDVTISNSKVVNSQNGVRIKTVYGATGTVSNVKFEDITLSGITKYGLVVEQDYENGSPTGTPTNGITVSGITFEKVTGTVESDATDIYILCGSGSCTDWTWSGVSITGGKTSSKCENVPTGASC

SEQ ID NO: 10657 - protein, 270 aa, Nicotiana alata
MAKKDGNQEEEISQMEEGNIHSASNSDSNVGFCSSVSVVVILQKLIAEAIGTYFVIFAGCGSVAVNKIYGSVTFPGICVTWGLIVMVMVYTVGYISGAHFNPAVTITFSIFGRFPWKQVPLYIIAQLMGSILASGTLALLFDVTPQAYFGTVPVGSNGQSLAIEIIISFLLMFVISGVATDDRAIGQVAGIAVGMTITLNVFVAGPISGASMNPARSIGPAIVKHVYTGLWVYVVGPIIGTLAGAFVYNLIRSTDKPLRELAKSASSLRS

SEQ ID NO: 10658 - protein, 475 aa, Castanea sativa
MSPQTETKASVGFKAGVKDYKLTYYTPDYQTKDTDILAAFRVTPQPGVPPEEAGAAVAAESSTGTWRTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 10659 - protein, 461 aa, Mesorhizobium loti MAFF303099
MSKTQTADQITEARRESHLFYLSSLRRPLIDRAEGIYMWTQDGRRFIDGSSGPMVANIGHSNRNVLDAMKRQMDRATFAYRLHFENEPAEELARELAKKLPEGMDRIFFVSGGSEATESCIKLARQWAVATGQASRWKVITRFPSYHGGTLGSLSITGDDALAETFEPMMRVMPTVPAPTAWRDRDNLSMEQRGVRYADMLEEKILAEGPESVVAFIMEPIGGAATAALVAPDSYYARTREICDHYGILLIHDEVMCGAGRTGKFLGGDHWNCKPDIVALSKGLGSGYAPLGALAAPMRLVQPLLASGGFQHGHTYAGNPLACAAGLAVLGEMDRLDLIANAAAMGDVLMDGLKGLAKRFPFIADVRGKGLLTGAEMVADPETLRPIEQGKKATQRLLDLAYERGLIIYGRRVKGGVDGDNFMVAPPMIVTSEQVGEIISIIGDSLEVLASELDLPVEGRG

SEQ ID NO: 10660 - protein, 367 aa, Mesorhizobium loti MAFF303099
MTASLFQPITLDGLTFPNRIAVAPMCQYSAEDGSASDWHLYHWMNLAMSGAGMVTVEMTDVERRGRISHGCLGLYSDDNEAAARRTLDAARRVAAPGTKFGTQLAHAGRKASNRKPWEGGGPLQPNEDPWQTVSASAMAYDTGWNVPRALDEEEILQLIERFAQAARRAERAGFDFIELHAAHGYLIFQFLSPLSNQRTDRWGGSLENRMRLVVEIARAVKKAVPKLMLGARLSVKDWVDGGFDVEDAIEVAKALKAEGIAYLCCSSGGNSPLQKLPTGPGYQVHLAEAVRKGAGIPTRAVGLIDDPQQAEAVIAEGRADMVALARAFLADPRWGWRAAATFKEKIHPAPQLARSVTTMEHWMKAAG

SEQ ID NO: 10661 - protein, 315 aa, Mesorhizobium loti MAFF303099
MPELERAPKLDQALAEVAAEMAERTDRGDVATYIPQLGKVDPRKFGIAAVTNDGRVLVAGDADQAFSIQSISKVFTLTLALGNVGDALWQRVGREPSGNPFNSIVQLEHENGIPRNPFINAGAIVISDILLAGHQPREAIGEILRFIQFLADDDTIIIDREVAASERATGYRNFALANYMKSFGNLHHAPELALGVYFHHCAIAMSCRQLAMAGRFLANGGKNPATGHSVVSAERARRIGAMMLTCGHYDGSGDFAFRVGIPGKSGVGGGILGIVPGVASLAVWSPGLNANGNSKLGSIALEKLARMMNWSIFAP

SEQ ID NO: 10662 - protein, 305 aa, Mesorhizobium loti MAFF303099
METIGFIGLGIMGAPMAGHLLDAGYKVIASDHRSKPLADLVAKGLKTVSGHAAVAKAADIIITMVPDTPQVADVLFGDNGVASGLTRGKLVIDMSSISPIETKVFAGKINELGCDYLDAPVSGGEVGAKAASLTIMVGGEEKAFERAKPVFEKMGKNITLVGPNGVGQTTKVANQIVVALTIEAVAEALVFASKAGADPARVRQALMGGLAASRILEVHGERMVKRTFAPGFRIELHQKDLNLALEGAKALGVSLPNTSTTQQLFNSCAANGGAREDHSALVRALERMANFEVGGAVAEVKGKAA

SEQ ID NO: 10663 - protein, 198 aa, Mesorhizobium loti MAFF303099 [sequence omitted]

SEQ ID NO: 10664 - protein, 512 aa, Mesorhizobium loti MAFF303099
MSDELLTSAEMGEADRLTIAAGPLDGYGLMQRAGEAVAAVVLARYPAASRVHVLCGPGNNGGDGYVVARILAGSGVATTIWASGAPRPQSDAALAAAQCPIASRPLSGFEAESGSIVVDALYGAGLSKPLSGDAARAVGVATDRRLPVVAVDLPSGVSGDSGRVLGVAFTAAVTVTFARKKPGHLLLPGLERCGEILLADIGIGDDIIARLQPRTFENRPAHWLRDFPVPAVDAHKYKRGHVGVFSGGPSATGAARLTALAAARSGAGAVTVLSPGNAMQVNAAHLTSIMLRKTDDVADIREFVGERRPSAFVLGPGFGVGDKTRSFGLALLASGPAQDAATQVDGLVFDADAITAFRDEQGVLFEAARGPHAPALVMTPHEGEFARLFPDIADDNASSKLDRARAAAARANAVIVYKGADTVIAAPDGRAAINSNGAAWLATAGSGDVLSGISAGLLAQAMPAFEAACAAVWIHAEAGSRFGAGLIAEDLPLALVPVLRELVEARRKVPVE

SEQ ID NO: 10665 - protein, 344 aa, Mesorhizobium loti MAFF303099
MPRSVIDAIGNTPLIRLNKASEETGCEILGKAEFMNPGQSVKDRAGLFIIRDAERRGLLKPGGVIVEGTAGNTGIGLTLVAKALGYRTVIVIPDTQSQEKKDTIRLLGAELIEVPAVPYKNPNNYVKLSGRLAEQMARTESNGAIWANQFDNVANRDGHIRTTAEEIWAQTGGKVDGFVSAVGSGGTLAGVAFGLKAKSKDVKIALADPLGAALYSFYTSGELKSEGSSITEGIGQGRITANLEGFTPDFSFQIKDEDALPIVFDLIQEEGLCVGGSTGINIAGAIRLARELGPGHTIVTILCDYGTRYQSKLFNPEFLREKNLPVPGWMELQSKISVPFEKVE

SEQ ID NO: 10666 - protein, 424 aa, Mesorhizobium loti MAFF303099
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 10667 - protein, 481 aa, Mesorhizobium loti MAFF303099
MAENYDVIIIGSGPGGYVTAVRSAQLGFKTAIVEREHLGGICLNWGCIPTKALLRSAEIMHYSDHLKDYGLKLDGKVSVDTSAVVDRSRKVSLRLNGGVAFLMKKNKVDVIWGEAKLSKPGEVVVSKTAKTPMEPQPPVPKGVKGEGTYTAKHIILATGARPRALPGIEPDGKLIWTYFEAMVPKEMPKSLLVMGSGAIGIEFASFYRTMGADVTVVELLPAVMPVEDAEVSKFAQKQFEKQGMKIILEAKVTKVEKGANSVTAHVEMKDGKVEKITADRMISAVGVQGNIENLGLEALGVKTDRGCIVVDGYGKTNVPGIYAIGDVAGPPMLAHKAEHEGVVCVEKIAGFPGVHAIDKLKIPGCTYCNPQVASVGLTEAKAKAEGKDIRVGRFQFAANGKAIALGEDQGFIKTIFDKKTGQLLGAHMVGAEVTELIQGFVVAMNLETTEEELMHTIFPHPTLSEMMKESVLDAYGRALNA

SEQ ID NO: 10668 - protein, 310 aa, Mesorhizobium loti MAFF303099
MTASPSFLGLPDRLDGRTPRAVIFGAGHGSTYPGKDSSGHALAADAIRAASQDDASLVEHWDFDLGGPLFNGKPASCVDAGDISTILHDNAENRVRIEAKTREVLALPAVPILLGGDDSVVIPFLAGFADHGPIWVLQIDAHIDWRDEVLGERHGYSSPMRRASEMPHVAGIVQVGLRSVGSARLAEIEAARHYGSRFVTAREVHAQGVDAALRHIPEGARVVATFDCDSLDPGIMPGVAARTPGGLTYTQAIDLIAGLGKRARIAGFDLVELYPPADIDGLSALTAARLLVNVIGTIASMTVSQSSSTA

SEQ ID NO: 10669 - protein, 399 aa, Mesorhizobium loti MAFF303099
MAATVIFLTTTGAGTWTVPADWNNSNNSIETIGAGLLGGGAYSKKNNVTLTPGGSVNYSVGSASSGVANDTFFGATTFAASICAAKAGGASLGGDAASGIGDVKYSGGARGLANGGGGGAAGPHGNGAAGGSGGGSGGGGNGGGSTGAASSFPSGGAGGNNFGGTGGGAGGAATALPGAAGTNGGGGGGGSPDDSDTPGVGGNGGNGTEWDATHGSGGGAGAGGDASTAGGSGGLYGGGAGRSNLSGGQGIIVITYTPGGAPDITGTLAATLAGGYIANITGTVQPLPPVNQIDMHDGKPREDHAAARNQAKREAHYKLRNAVRKAARKANGAADEPAEQPADLKEMARAIQAEIKTDGIVARLRDIRKLVAEYQAELARLAQEAEDETVAILLLTGDI

SEQ ID NO: 10670 - protein, 463 aa, Mesorhizobium loti MAFF303099
MAGYDYDLFVIGGGSGGVRAARVAATLGKRVGIAEEYRFGGTCVIRGCVPKKLYVYASQFPEHFADAAGYGWTVPEASFNWQTLVANKDREISRLEAIYKKNVEGAGGETFPSRAMIVDPHVVHLLDDDRTVTADQILIATGGRPAAHPALPGHEHCIFSNEAFDLKELPKAIMIEGGGYIAVEFANIFHGLGVDTTLVYRGKEILSRFDMDLRRTLHETMEKKGIKILCHAVSERVHKRPDGRLDALLTSGQTLTVDQVMLAIGRIPNTENMGLEGIGLEMTQAGAIKVDEYSRTNIDNIWAIGDVTNRVQLTPVAIHEAMCFVETAFKGNPTAPDHDTIATAVFSQPEIGTVGLSEDEAVKRFADVEIYRASFRPMRHTLSGRDEKMLIKLVVDGASRKVLGAHILGPDAGEMAQLLGIPLKAGLSKDDFDRTMAVHPTAAEELVTMYKPTYRVKDGQRVQ

SEQ ID NO: 10671 - protein, 289 aa, Mesorhizobium loti MAFF303099
MASVAFLGLGVMGYPMAAHLRNKGDHDVTVYNRTKTKAEQWVDQHGGSLAVTPADAAKDKDFVFSCVGNDDDLRSVTTGPEGAFKSMKKGSVFIDNTTASAEVARELAAAAEAGGFSFLDAPVSGGQAGAENGVLTVMVGGDQAAYDRARPVIDAYARMVGLMGSAGAGQLTKMINQICIAGLVQGLSEGIHFGKKAGLDIEKVIEVISKGAAGSWQMENRHKTMNAGKYDFGFAVDWMRKDLGICLAEADRNGAKLPVTALVDQFYKDVQAMGGKRWDTSSLLARLEK

SEQ ID NO: 10672 - protein, 256 aa, Mesorhizobium loti MAFF303099
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 10673 - protein, 170 aa, Mesorhizobium loti MAFF303099
MAEIKDRENALIMETTKGKVVIELFPDLAPGHVARIKELAREGAYDGVVFHRVIDGFMAQTGDVKFGNSSKPTFAPSRAGMGGSDKPDLKAEFSNANHGRGTCSMARSQNPNSANSQFFICFDDAAFLNRQYTVWGQVIEGMDNVDKIKRGEPVVDPDKIVSLKVAADVK

SEQ ID NO: 10674 - protein, 269 aa, Mesorhizobium loti MAFF303099
MAKGNGIKVEEKDESEIVLSVRDVTVAIEDKLILDKLSLDIKRGEILGFVGASGAGKSVLLRTILGLMPKQSGTIKLFGVDVDKASDIERLRIDMRLGVLFQHGALFSALTVQENVQVPMREYLDLPRKLMDELALLKIELVGLPPDAAQKFPSELSGGMIKRAALARALALDPDIVFLDEPTSGLDPISAAEFDELVVKLRDTMDLTVYMVTHDLDTLFTACDHVAVLGKKKVLVEGTIDDMLKSEEPWVKSYFRGKRARQLDLAARA

SEQ ID NO: 10675 - protein, 375 aa, Mesorhizobium loti MAFF303099
MKTRAAVAVAAGKPLEIMEVDLDGPREGEVLVEIKATGICHTDEFTLSGADPEGLFPAILGHEGAGVVVDVGKGVTSVKKGDHVIPLYTPECRQCPSCLSRKTNLCTAIRATQGQGLMPDGSSRFSIGKDKIFHYMGCSTFSNFTVLPEIALAKVNPDAPFDKICYIGCGVTTGIGAVINTAKVEQGATAVVFGLGGIGLNVIQGLKLAGADMIIGVDLNNDKKAWGERFGMTHFVNPKEIDGDIVPHLVNMTKRGADQIGGADYTFDCTGNTKVMRQALEASHRGWGKSVVIGVAGAGQEISTRPFQLVTGRTWMGTAFGGARGRTDVPRIVDWYMDGKIQIDPMITHLLKLEDINKGFDLMHEGKSIRSVVVY

SEQ ID NO: 10676 - protein, 153 aa, Mesorhizobium loti MAFF303099
MSALGFPKTPSDKKALEEGAVFSPRFDPAGLVTVVVTDAEDGMLLMVAHMNAQALALTLETGIAHYWSRSRNALWKKGETSGNFQHVVEMRTDCDQDALWLRVKVLGHDATCHTGRRSCFYRTVGLVDGKGTLVDDGSKPLFDAEFTYRKPSS

SEQ ID NO: 10677 - protein, 403 aa, Mesorhizobium loti MAFF303099
MEEFHKVRRLPPYVFEQVNRLKASARSRGADIIDLGMGNPDLPTPKAIVDKLCEVVRDPRTHRYSSSRGIPGLRRAQAAYYQRRFGVKLNPDTQVVATLGSKEGFANMAQAITAPGDVILCPNPTYPIHAFGFIMSGGVIRSLQVEPDDGFIPALERGVRHSIPKPLALILNYPSNPTALVASLDFYKDVVAFAKKNDIIILSDLAYSEIYFDGNPPPSVLQVPGAIDVCVEFTSMSKTFSMPGWRMGFAVGNERLISALTRVKSYLDYGAFTPIQVAAAHALNGDEIAEVREVYHKRRDVMVDSFGRAGWNIPAPAASMFAWAPIPEPFKHLGSLEFSKLLIEHADVAVAPGVGFGEHGDDFVRLALVENEHRIRQAARNIKRFLSTSAKQPNNVVPLSAHR

SEQ ID NO: 10678 - protein, 495 aa, Mesorhizobium loti MAFF303099
MAVRNDVSTRSYQQFIGGRFVDGSGSGSIERRSPATGDLVARYADGTPEDVDLAVEAARIAFEDGPWPRMSGMERAEVLNRLADLIRTNRDRLVRIEVEEVGKPVRFARGDIDGAAGLTRYAASLAMQMAGLTYTNIGDGKTALISREAVGVVALVTPWNFPALILSQKVPFALAAGCTVVLKPSEFTPGSAFEIAALAAEAGVPAGAFNVVSGYGATAGDHLTGHMGIDFVSFTGSTRTGSRVVGNTSRHLVKSSVELGGKSANIVFADADLEAAADGALMGVFFNNGECCVSGSRLFVQSSIADDFIAKVIARSRKMKVGDPFDDDTDVGALIDRNHLAKVTGFVKSGIEEGAQLVLGGNVAAGAVGHFHEATIFDRVEPHMTIFREEIFGPVLSITRFDTVDDAVRLANDTAYGLSNYIWSKNIDTVLTVAKRLKSGWVQANTIIDGAPQLPLTGVKGSGFGYEMGQAGFEEFTQLKTLLIQTGPRAPVFPV

SEQ ID NO: 10679 - protein, 301 aa, Mesorhizobium loti MAFF303099
MSSWRKTAPRPPRSSPSIDMSQNAKIVMDAVRAADHDRYLTALYAPADKREALFSLYAFNAEIAGIRDRIHEALPGEVRLQWWRDLIAADNDAAIGHPVADALKATISGHHLPKLAFDNMLEARIFDLYDDPMPSRTDLEGYCGETAAALIQLAAMVLDPVEAPRFAELAGRAGCAQAMTGLLLLLPLHRKRGQCFVPADILAAAGSSPEEFVAGDGGPGAQRAVAAMIALAREHLSAFEQGAAELPASLRPAFLPLALSRAYLDRTEGARQSTLDGVARLSALRRHWLLVRRASKGWPAL

SEQ ID NO: 10680 - protein, 346 aa, Mesorhizobium loti MAFF303099
MKAVVFEKFGEAPTIQTVPDPKPAADGVVIKVEATGLCRSDWHGWMGHDDGITLPHVPGHELAGVVVAAGKQVSRWKAGDRVTVPFAVGCGRCFECSSGNHQVCEHQTQPGFTGWGSFAEYVGIEHADTNLVRLPDEMEYATAASLGCRFVTSFRAIVDQGRVKPGEWVAVHGCGGVGLSAIMIASSMGANVIAIDLTDEKLEFARKIGAVATINASTTPNVVKAVKQIANGGAHMSMDALGHPTTSFNSIANLRRRGRHVQVGLMLGEHARPQVPMDKIIAFELEILGSHGMQAYRYQAMMDMIRNGKLKPELLVGKKISLDEAPAALMAMGGFEGIGIGVVTKF

SEQ ID NO: 10681 - protein, 1217 aa, Mesorhizobium loti MAFF303099
MTAGPLPDARSTGPAMPLDTIRQQIRANYLPDEDEAVKRLAEATGLSAADRDAISARAADLVRAVRGSSDPRLMEVFLSAYGLSTKEGVALMCLAEALLRVPDTETMDDLIADKIAPHDWSAHSGGSSSIFVNASTWALMLTGRVLDEGEGGIEGTLRSMVRRLGEPVIRKAVAAAMREMGEQFVLGRTIAEAVKRGRPMTQKGYLYSFDMLGEAARTEADALRYHKAYADAISSLDAGSNGPDIRQNHGISVKLSALHPRYEVAQKEEMLPVMAERLLSLALAARHSRMGLNIDAEEADRLDLSLDVIERVLAEPELAGWNGFGVVVQAYGPRAAFVIDWLYALARKYDRTIMVRLVKGAYWDTEIKRAQTLGLAGYPVFTRKANTDVSYMACAKKLLGMTDRIYPQFATHNAHTVAAILSMATNRDSFEFQRLHGMGEALHETVRQAEGTRCRIYAPVGAHSDLLAYLVRRLLENGANSSFVHQLTDEDVEPEDIARDPLETVESQGPAANPAIARPSQIFGAGRRNSRGFDITDTVTLAAIDKARAAFAGPDRWHAKPITRAAGYGKPHPVVNPAKPDEVVGTVHEAAAKQVAIAVRIAVEAQPAWAKRPVGERAAILNRAADLYEANAVEFFALATREAGKSLADGVAEVREAVDFLRYYAAEAANAETGTQARGAIVCISPWNFPLAIFTGQIAAALVTGNSVIAKPAEQTPLIAFRAVELLREAGVPEDIIQLLPGDGPSVGGPLTADPRIAGVCFTGSTEVAKLIEKQLAETAAPDAMLIAETGGLNAMIVDSTALPEQAVRDILASAFQSAGQRCSALRVLYVQKDVEKKMLDMLKGAMEALNIGDPWRISTDVGPVIDDEAQASIRDYCTRKGLEGRLIAKLEAPKDGRFVAPHVFRVKGIEEMEREVFGPVLHVASFDADEIDAVIAAINRKGYGLTFGLHTRIEGRVQHFVDGIHAGNIYVNRNQIGAVVGSQPFGGEGLSGTGPKAGGPHYLRRFRKGPEAGTEVGEGHKVTATELADNLPDPALGGWSTRPDRIAILRKHLRGKGAAAIGAAAAIDFGQVDLPGPTGEANTLSLSPRGRVLCLGPDAETLLAQTIQALAAGNAVLAVAPGAPAALSALTGKGLPLAAIDGRPDPVEARALRVDVVAFSGTPEAARIVRQVIADRTGPIVPLVSEVLNPAAYAHERAVCVDTTAAGGNASLLAAA

SEQ ID NO: 10682 - protein, 485 aa, Mesorhizobium loti MAFF303099
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 10683 - protein, 294 aa, Mesorhizobium loti MAFF303099
MTTIAFIGLGNMGNPMAANLVKAGHQVHGFDLMPENLTVAREHGVVVMANAPAAVKDADVVITMLPAGKHVLSVYEDIAPKAKKDALFIDSSTIDVESARKAHAIAAKHGLLSIDAPVSGGTGGAAAGTLTFMAGGSNDAFAAAEPVLKPMAGRIVHCGGDGAGQAAKICNNMILGISMIGVAEAFVLAEKLGLSHQALFDVASTSSGQCWSLTTYCPVPGPVPTSPANRDYRPGFAAALMLKDLKLSQEAAQSAGAVTPLGAEAAQLYALFNAQGHGGADFSGIINFLRGNPA

SEQ ID NO: 10684 - protein, 459 aa, Mesorhizobium loti MAFF303099
MTYQNYSLKQLQQIDAAHHLHPFTDHKELREAGSRIITHANGPFIYDSEGTELLDGMAGLWCVNIGYGRDELAEAAYAQMKELPYYNSFFKCSTPTPVLLSKKLAEIAPKNVNQVFYGSSGSEANDTALRLVRHYWVIEGKPEKNRVISRKMAYHGSTIAGTSLGGMDAMHKQLNGAVPNIVHVMMPYAYELALPGESDHDFGLRAAKSVEDAILEAGVDKVAAFIGEPVMGAGGVKIPPASYWPEVQRICRKYDVLLMLDEVITGYGRTGEWFAAQTFGIEPDTITTAKALTSGYQPLSALLVGDRITSTLVEKGGEFNHGYTYSGHPVACAVALKNLEIIEQEGLVDRVRNDTGPYFAKALQECIAGHDLVGEVRSIGLMGAIEIVKDKATKERFLPSGSAAVTVRDHAIANGMMLRATGDTMILSPPLIWTRDTIDMACERIGKALDLAQADLRKR

SEQ ID NO: 10685 - protein, 490 aa, Mesorhizobium loti MAFF303099
MTVMAKPEQTNARTLVSAPALSPAAIAKPDLISVEQAKAMDVAGMTDLFKAHLNPGQLHFMKLLGFHKIKIERAEGMFYIDQNGRKILDFFGGFGSLAFGHNHPRILDARKKFQEEKRQEIAIAFMSQYAAALAHNLAKCSPGDLDMVFLGSSGSEAMEAAVKLAERAAGPKRPKVVYAENSFHGKTKGVLGITDGQLYRADFKVADNTVRIPFGDIEAVERLFRSDPEVGVIVLETIQGGGGIIQAEAQYWQKLRALCDQYGVLWVADEVQCGYGRSGRFYAFEHYGVVPDVTALAKSLGGGKAAVGAMIARREIYMKAYGTPKTAMIHAMATFGGMGEACVTSIEALNVLYDEGLIDNAAVTGDYLLQRLRALKEKYPKIIKDVRGKGLMVGLEFHDFSQTLPMVLRPIVSVLDDKLKGSLSGFVGALLLRDYDVLVAFTEYNRNVIRLEPPLICQREHVDRFVDAFDSLLSRGIVSIVKDFVKSQVR

SEQ ID NO: 10686 - protein, 442 aa, Mesorhizobium loti MAFF303099
MSNRLKVTPNDLSAFWMPFTANRQFKQAPRMFVSAKDMHYTTSDGRKVLDGTAGLWCVNAGHCRPKITEAIQHQAAELDYAPAFQMGHPIVFELANRLVDIAPKGMDHVFFTNSGSESVETALKMAIAYHRMKGEGARTRLIGRERGYHGVNFGGISVGGIVSNRKMFGTLLGGVDHMPHTHLPEKNAFSKGVPEYGAELANELERIVALHDASTIAAVIVEPVAGSTGVILPPKGYLQKLREICTKHGILLIFDEVITGFGRLGAPFAADYFGVVPDIMTTAKGVSNGVIPMGAVFVKKEIHDAFMTGPEHMIEFFHGYTYSGNPIACAAALGTLDTYKEEGLLTRGEELAPYWEDALHSLKGEPHVIDIRNIGLIGAIELAPIAGSPTKRAFSAFVKAFERGALIRTTGDIIALSPPLIITKGQINELIDHVREVLRSID

SEQ ID NO: 10687 - protein, 279 aa, Mesorhizobium loti MAFF303099
MDLKDKTILITGSTDGVGRVVAQRLGADGARVLVHGRDAARGKAAVAEIEAAGGRAEFFAADLASLAEIRHLAEAVRARTNRLDILINNAGIGTAAAKRQVSADGYELRFAVNYLAGFLLTSELLPLLKASAPARIVNVASAGQQAIDFGDVMLTHGYSGVRAYCQSKLAQILFTVDLAEQLKGTGVTVNALHPASYMNTTMVRQAGVTPWSSVETGAEAIVNLAASPALEGRSGLYFDGLREARADAQAYDATARQQLRSLSRDLVGAASSKSRERHS

SEQ ID NO: 10688 - protein, 451 aa, Mesorhizobium loti MAFF303099
MPEGQFKEGIVGGRLAAEQYADNFSDLHPPLDHHEGLVESDRCYFCYDAPCMNACPTSIDIPLFIRQISTGNPIGSAKTIFDQNILGGMCARVCPTETLCEEVCVREVAEGKPVQIGRLQRYATDVAMAENKQFYPRAEPTGKTVAVVGAGPAGLAAAHRLARHGHDVTILEARPKAGGLNEYGIAAYKSVDNFAQAEVEYVTAIGGIDIQNGKALGRDYQLSDLIRNYDAVFLGMGLGGVNALRADGEDAEGVTNAVEFIAELRQASDLSGLPVGRRVVVIGGGMTAIDAAVQSKLLGAEEVTICYRRGQEHMNASGFEQDLAAANGVTIRHWLQPKRVIAEAGQVSGIELEYTALKGDKLAGTGETLTLVADQVFKAIGQSFVPAALNGSEASIELEAGRIKVDGEGRTSLAKVWAGGDCIFGGDDLTVSAVAQGRDAAESIHRSLTQG

SEQ ID NO: 10689 - protein, 346 aa, Mesorhizobium loti MAFF303099
MEVRVANVRKEFERFPALHDVSLDIKSGELIALLGPSGSGKTTLLRLIAGLERPTRGKIFFGDEDASQKSIQERNVGFVFQHYALFRHMTVADNIGFGLKVRHGSSRPPAQEIRRRASELLDLVQLSGLEKRYPAQLSGGQRQRVALARAMAIEPKVLLLDEPFGALDAQVRRELRRWLREIHDRTGHTTVFVTHDQEEALELADRVVVMSQGRIEQVGTADDIYDTPNSPFVYGFIGESSSLPVKVENGEIWLADRPIGLSAPHAPEGEATLYFRPHDVELLDGCSGCIAGTVAASRRVAGTRRVELEIGGERQRVEIELPVGHPAAQKSRVAFRPGRWKLFPAA

SEQ ID NO: 10690 - protein, 312 aa, Mesorhizobium loti MAFF303099
MNTTTAREKIGFIGLGLMGHGIAKNIVDKGYPLTFLGRKNRKPAEDLLGRGAREASTSRDVAVASDIVFICVTGSREVEAIIRGPGGLKEGLKKGSVVVDCSTSDPVSTVALAAELKALGIDYVDAPLSRTPKEAWEGTLDAMVGAPDAVFARVKPVIETWAGRIVHIGDTGDGHRMKLLNNFISLGYAAIYSEALALAEKVGISPPRFDSVIRNGRMDCGFYQTFMRWTLEGDRDAHKFTIANAFKDLTYLESMAGAAGIANPLGNATKNAFAGAHATGPAEQFVPMLATHIGKVNGVDLMPTKDGKKQTI

SEQ ID NO: 10691 - protein, 334 aa, Mesorhizobium loti MAFF303099
MTLATRKLGSQGLTVSAIGLGCMGMSQSYGPADEAESIATLHRAIELGCTFLDTAEVYGPHTNEALLGRALKGKRDQVTIATKFGFRIENGKQLSGVDSRPEHIREVVEASLGRLATDHIDLLYQHRVDPDVPMEDVAGAVGKLVAEGKVRFFGLSEAGSANIRRAHAVFPVSALQSEYSLWERNLEPEIIPLLKELGIGLVPFSPLGRGFLTGDVKRAEDYPEGDYRRNDPRYQGENYDANVEAAGTVRAIAAARGVKPGQIALAWLLGKGIGFGMDIVPIPGTKRRKYLEENVAAASLKLDAAEMAALDEALAPEKISGPRYGERGMAMVDR

SEQ ID NO: 10692 - protein, 495 aa, Mesorhizobium loti MAFF303099
MALHAGAQPDRVACVDLASGRRWTYAALDEAIQRTVRVLETGYGIKPGQRIATLARNSADLLILQQAAMRLGAIFVPVNWRLASAEQQAILADCDPALLLHDAAPQAALPGRCIPVDVAAFTAAVEAETLAPRRPLPADDAPSIILYTSGTSGRPKGVIVTERNAFATAVNFSVLGRVGNASIFLCDAPMFHVIGLITSLRPTLLQGGTVLISPGFDAGATNRRLADPALGVTHYFCVPQMARMLRDHPDFAPSRWTSLTAIFTGGAPNPATDIRWWLAQGVRMADGFGMTEAGTVLGMPVEAGRIAGKAGSAGLPAPTIGLRLVDDDGRDVAAGEPGEIWLSGPSITPGYWNRPEETQRAFTADGWFRTGDIARRDGEGFVTLVDRRKDMFISGGENVYPVEIETVLLDHPGIAEAAVIGIADARWGEVGRAFVVVKPGCAVDPADLASHCGARIARFKVPKEFLLTDALPRTASGKIQKHILRSWTAPVRKHS

SEQ ID NO: 10693 - protein, 355 aa, Mesorhizobium loti MAFF303099
MANEHQETDMNDELVLVTGGSGFIASHCMLKLLDAGYRLRTTVRSLEREAEVRAMLREGGAEPGDRLSFVAADLTADAGWAEAVAGCAYVMHGASPTPSGSQTREEDWVRPAVDGVLRVLKAARDAGIKRVVLTSAIGAVAMGHAPQTRPFNETDWSDLSGAVAPYQRSKTLSERAAWDFIAREGGGLELSVVNPVAVLGPVLAADFSHSIGLIKRLMDGMPGCPRVNSGYVDVRDLADLHLLAMTSPAAKGERFIGISGHSLWMADVAKVLRRRMGAAAAKVPTREIPNWMIRLLALRGDPTTKMLARHLGVMMDATSEKATRLLGWTPRPAEEAIVATAESLLRLGLVGGSKA

SEQ ID NO: 10694 - protein, 228 aa, Mesorhizobium loti MAFF303099
MTDLRRRLAAEALGTAMLVATVVGSGIMASRLTGDVALSLLGNTIPTGAILVVLITTLGPVSGAHFNPAVTLVFGLRRDIGWLAVLGYITVQILGGLAGTLVAHAMFELPLLEVSATVRSGQGQWLAELVASFGLVFTILAGLRFRSDAIPWLVGLYITAAYWFTASTSFANPAVAIARASSNTFAGIRPSDVPAFIAAELAGALLALALAGWLLAEPKTLTEMKAAQ

SEQ ID NO: 10695 - protein, 371 aa, Mesorhizobium loti MAFF303099
MTTLFDPLRAGDLTLANRIVMAPLTRNRSPNAVPGDLSVTYYSQRATAGLIVTEATAISHQGQGYANVPGLYGADQLAGWRRVTDAVHRGGGKIVVQLWHVGRISHNTLQPGGGKPVAPSAIRANSKTFLVKPDGSGEFAETSEPRALDAAELPGIVDDFRRAAKAAIEVAGFDGVEIHGANGYLIDQFLRSGTNHRNDAYGGSIENRTRFLFEVVDAVTGAVGAGRTGIRLSPVTPANDASDSDPQPLFNHVVAGLGGRGLAYIHIVEGATGGARDFSQGDRPFDYEELKATYRKAGGAGAWLVNNGYDKELAEKAVGDGYAELVAFGKLFIANPDLVSRLKRNAELNAPDKATFYGGDARGYTDYPTAA

SEQ ID NO: 10696 - protein, 477 aa, Mesorhizobium loti MAFF303099
MSHNLQFYVDGAWVDPVVPNTLDVIDPSNEDAFAQISLGSKADVDKAVAAAKRAFNSFGFTSVEERLDILNRVIEVYKKRSKDLALAVSREMGAPRQMALDSQVGVGLAHLEKMAEVLRTFQFRHVKGSALIVKEPIGVVGLITPWNWPLNQITCKVGPALAAGCTMVLKPSEIAPLDAIIFAEIIDEAGVPKGVFNLVNGDGPGVGQALSSHPDVDMMSFTGSTRAGILVAKAAADTVKRVHQELGGKSANILFPDVDLARAVTKGVAGCFGNSGQSCNAPTRMFVPRDRHDEAAGYAKAAAEKFVVGPADGANTKLGPVVSQMQFDKIQDLIQAGIDEGATLVAGGPGRPAELNRGYYVRPTVFADVTHDMRIAREEIFGPVLAILPYDTVEKAVEQANDTVYGLASYIQAKDIQKARDVAARMRSGNVYINYPAWDAGLPFGGYKQSGNGREYAEYGLEDFLEIKGIAGYEAAE

SEQ ID NO: 10697 - protein, 498 aa, Mesorhizobium loti MAFF303099
MTLSFDPRAKATTLYHGEFRPMFIGGKWVAAQSGQEMQALNPATGEVLTTVPRGGAADVDAAVAAARAAFEGPWSKFSPYERQCVLLRIADLFETHWEELSVSDTLDMGLPITRTLANRRRVIGMLRFYGGMATALHGEAIDNSIPGEIVSFTRREPVGVVGAIIPWNAPTAASIWKIAPALATGCTIVLKPSEEASLTPLLIARLMQEAGVPDGVVNIVTGTGAEAGARLAEHPDVNKIVFTGSTLTGQAIARAGVTNLKRVSLELGGKSPIIVCRDADIDKAVPVAAMAVFVHSGQICIAGSRLFVAREIHDEFVRRVAEFAGRLRIGHGIEAETEIGPLINARQAGKVEGYIKAGSDEGAKLVAGGSRLTGALYDGGNFIAPTVFGSVSDKMTIAREEIFGPVISAMPFDTLDEVVARANATPYGLAAGIFTTHLGTAHKLARRIRAGSVWVNMYHAIDPAVPFGGMKMSGYGREGGIEHLHEYLETKSVWIQTD

SEQ ID NO: 10698 - protein, 305 aa, Mesorhizobium loti MAFF303099
MSESYAFIGLGHLGGNLAPSLIRNGFAITVFDRDPAAVERLVTLGATAANSPAEAAARAGNAITCLPSPKISEAVLAGPGGLLEGLPKGGTWIEMSTNGRDEIMRLAALASAEGVETLECPVTGGVHLAAVGKITALVGGDAALYERHRAAIEAMCARSFLMGPIGSAAVIKVITNMLAFIHLVAAGEALMLAKQGGLDLAQSYHAIVASSGNSFVHETESQLVLNGSYDIGFTMDLALKDLGFALGMGKDFGVPLELASRVNAIFEKGKAAYGGGAWSTQIVKLLEDAVGTDLRAPGFPARLEI

SEQ ID NO: 10699 - protein, 458 aa, Mesorhizobium loti MAFF303099
MTAKTFDAIIIGAGQAGTPLAGRLNAAGMSVALIERKLVGGTCVNTGCIPTKTMVASAYAAHLARRATDYGVTLGGPVGVDYKAIKARKDKVSGASRTGLESWIAGMDKCTLYRGHARFESANTVRVGDDLLTADKIFLNTGGRASVPDLPGIHDIDYLTNSSMMDLEVLPRHLIVVGGSYISLEFAQMFRRFGSEITVIEKSPRLTGREDEDVSATILSILENEGITVHVGADDIGFAKQGDDIAVTFSAGKPPAVGSHVLLALGRTLNTDDLGLDRAGVAVDKRGAIIVDDQLRTSVPGIWAMGDCNGKGAFTHTSYNDYEIVAANLLDNDPRKVSDRIEAYALYIDPPLGRCGMTEAAVKKSGRRALVGQRPMTRVGRAVEKGETQGFMKILVDADTRQILGCSVLGPGGDEAVHCVLDLMYAKAPVDTLARATHIHPTVSELLPTIAQELKPLA

SEQ ID NO: 10700 - protein, 308 aa, Mesorhizobium loti MAFF303099
MRAVIQNSFGGPEILVVANQPDPAPKAGEVLVRVRAAGINPVDGAVRAGYYPLLGEPPFILGWDISGTVEALGAGVTGLKVGDEVFGMPRFPKQAAAYAELAVVPADEVAPKPKAADHIQAGALPLAGLTAWQGLVRHGALKSGQRVLVHAAAGGVGHLAVQIAKARGAYVIATASPNKLDFVRKLSADEVIDYTQGDFAGRISDIDLVLDPIGGEHAERSLKVIRNGGVLVSLLDLNEATRALASARDIRVERMSVVPDREGLMELGRLIDANKLTVHVAKSFPLEESGAAHAFLATKPIGKVALTV

SEQ ID NO: 10701 - protein, 398 aa, Mesorhizobium loti MAFF303099
MAADKNAFVWEDPFLIEDQLSEEERMVRDGAAAFAADKLAPRIEDAYLNEKTDAGIFREMGEAGLLGITIPEEYGGLGANYVTYGLVAREVERVDSGYRSMMSVQSSLVMYPIHAYGSDEQRKKYLPKLASGEWIGCFGLTEPDAGSDPGGMKTRAEKTANGYKLSGSKMWISNAPIADVFVVWAKLKGETGKDEIRGFVLEKGMKGLSAPKIGGKLSLRASITGEVVMEGVEVGEDALLPNAKGLGGPFGCLNRARYGISWGSMGAAEDCWHRARQYGLDRKQFGKPLAGTQLYQKKLADMQTEIALGLQASLRVGRLLDAGKMAPEMISIVKRNNCGKALDIARQARDMHGGNGIQIGYHVMRHAQNLETVNTYEGTHDVHALILGRAQTGIQAFF

SEQ ID NO: 10702 - protein, 484 aa, Mesorhizobium loti MAFF303099
MGKVTGFLEIDRQVHKYQPASDRIRHFREFTLPMSDKEVEKQAARCMDCGIPFCHGPTGCPIHNQIPDWNDLVYNRDWDNAIRNLHSTNNFPEFTGRICPAPCEEACTLNLEDIPVAIKTVEQAIADKAYETGHIRPYPPEKKTGKRVAIIGSGPAGMAAAQQLGRAGHDVHVYERESRPGGLMRYGIPDFKIEKHYIDRRIEQMQGEGVTFHCGVNVGVDKPVAELLAEHDAVLYCGGSETPRAANIPGDDLGGVHDAMPYLVQQNRRVGGEPIQSVAWPSHPIIAGGQHVVVVGGGDTASDCVGTAFRQGAVRVTQLDIRPQPPEKEDKLAVWPYWATKMRTSSSQAEGAEREFQVATLEFIGEDGQLTGVKCCEVDEKRKPIAGTEFVIRADLAFIAIGFAGPAMVGVAKELEGEMKITTDSRRSRNVEANDRDYKTSVDRLYAAGDVRRGQSLVVWAIREGRQAARSIDEALMGTSVLPR

SEQ ID NO: 10703 - protein, 475 aa, Mesorhizobium loti MAFF303099
MEKAEIGLIGLGTMGSNLALNIAEHGHRIAVFNRTRARTDAFVENAGALKDMVVPCYSLEELAAAIRPPRPIIIMVLAGKPVDEQIEALRGVLSGNDIVIDAGNANFRDTMRRFSELSGSGLTFIGMGVSGGEEGARHGPSIMVGGTEDSWKRVEKVLTAISAKFKDEPCAAWLGTDGAGHFVKTIHNGIEYADMQMIAEIYGILRDGLGMGPKDIGTVFSNWNKGRLNSYLIEITAKVLAADDPKTGKPVVDIILDRAGQKGTGKWSVIEAQQLGIPATAIEAAVAARVLSSIKDERLAAEKAYGNIGVSKISGDKDALLKDLELALFAGKIAAYAQGFAVMSGASKEFNWNLPMPTIARIWRAGCIIRSQMLDTMAEAFSSGGASTNLLMAPAFISLMQEAHPSLRRIVAKASEAGAPVPALSSALAYFDSYRQGRGTSNLIQAQRDFFGAHGFERIDEQGAFHGPWGSGAAG

SEQ ID NO: 10704 - protein, 180 aa, Mesorhizobium loti MAFF303099
MPIVRDKDIEVLFSASAIARRNLELAKEIAGHDYHDLLVISVLKGSFIFAADLIRAMHDVGLSPEVEFIFISSYGAGTTSGEVRVLRDIDNEVAGRDVLLIDDILESGKTLTFTRDLMLSRGAKSCSIAVLLDKRMRRQTALVADYVGFDCPDYFVVGYGMDVAHAFRELPFVGVVKGDA

SEQ ID NO: 10705 - protein, 472 aa, Mesorhizobium loti MAFF303099
MAAVRDLKATEMAASGGDDAIELGKRHLIQPWPYAGSVGAEARALIGEGDGIYITDNTGKRLIDGPAGMWCVNVGHRREELARVMYDQAMALSYNTPWYTMNAPSAELAMRIAGHAPDDLSHVFYTTGGSSAVETALRFMQFYNNVRGRPEKKLILSRGGAYHGSTYLSASLNGRPRDRDWMDGADELVIKLSSPDPFRRPQGMSLAAFTDFLVDQFRDTVARVGADKIGAFVGEPVQASGGVVIPPDGYLKRIREICRVNDILYVSDEVVTGFGRLGHVFASGDVFGIDPDMITFAKGVTSGYFPLGGVIISERLLQELRRSNHPDAMFGHGLTYTSHPVGCAVALKNLDLLEESVLAHTQAVAPYFQAQLKTLEELPLVGEVRGAGLMGCVECVADRESKNPLQLDKDVGKRIDAHCHELGLLVRPLINMCVMSPPLIITREQIDDMVGILREGISRTMDDLWKEGVWRG

SEQ ID NO: 10706 - protein, 357 aa, Mesorhizobium loti MAFF303099
MIEIRNVTRSYGSFKALDDASLTIREGEFFSLLGPSGCGKTTLLRMIAGFDNPTSGSIAVGGQPMEGIPANRRPTNMVFQSYAIFPHLNVEQNVAYGLKRLKLQGGEEKRRVEEALAQVSLTGLGKRLATELSGGQRQRVALARALVMRPKVLLLDEPLSALDKKLREQMQVELRRLQQAVGITFVLVTHDQYEALAMSDRIAVMFGGRIAQVASPKEIYQRPVNRQVADFLGGMNFVKAEIVEENGASLIVDTLGFGRVKTDKPKAFVRNGGGATLGIRPERLRVLWDNATAKFEVAGKVVERHYFGEITHLIVEIPGLEKPLSVTETNDFGADDIPVGTTIRLAYDPEALVAMGD

SEQ ID NO: 10707 - protein, 398 aa, Mesorhizobium loti MAFF303099
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 10708 - protein, 342 aa, Mesorhizobium loti MAFF303099
MMSERLEDIAAAIVANGKGLLAADESSGTIKKRFDVIGVESTADSRRDYREMMFRARDAMTKYISGVILYDETIRQKAADGTPLVDIIKASGAIPGIKVDAGAKPLAGFPGDTVTEGLDGLRERLADYYKLGARFAKWRAVIDIDTGKGVPSANSINSNTHALARYAALCQEAGIVPIVEPEVLMDGAHDIGTCYDVSKATLIKLYDELHAARVVLEGTILKPNMVLSGKKSGTVDSPEKVAEMTIKLFRETVPAAVPGIAFLSGGQEDEEATANLNAINAIGPHPWKLTFSYGRALQAAPQKAWSGKASNVAAGQAAFTHRAHMNYLAALGKWKASLEQAA

SEQ ID NO: 10709 - protein, 326 aa, Mesorhizobium loti MAFF303099
MTAIAISVPGGPRVLKPETRDVPQPGPGEILIKVHAAGVNRPDVQQRKGAYPPPPGASDLPGLEVSGEVAALGDEISRWRIGDRVCALTPGGGYAEYVKVHSGSVLPLPAGFTHTEAAAVPENYFTVWHNVFERGALKKGETLLVHGGSSGIGTTAIQLASAFGAYVITTAGSKEKCDACLKLGADRAINYREEDFVTAVKEATDGKGATVILDMVGGDYVQRNYEAAAVEGRIVQIAVQAGAVASADFSKIMVKRLTHTGSTLRPRTVEFKAAIAAALEAQVWPLLGTRKVAPVMDMIYPLTDAWRAHERMEEGEHIGKIVLDVG

SEQ ID NO: 10710 - protein, 264 aa, Mesorhizobium loti MAFF303099
MSDATNASPALLDVRDVSKAFGTVEVLRSVSLQVKRGEVVTVIGPSGSGKTTLLRCVNFLESYDSGSIRIDGKEVGYREAGTRQRRSERDLAAMRAETGMVFQSFNLFPHLTAAGNIMLGLTKVRGKGQAEARQIAEHWLGRVGLAHKADSLPAELSGGQQQRVGIARAVAMEPKILLLDEITSALDPELVGEVLAVVRSLAEDGMTMLMVTHEMAFARDASSRIVFMADGCVSAVGPPKEILAAETSNERLRTFLARFRASHF

SEQ ID NO: 10711 - protein, 478 aa, Mesorhizobium loti MAFF303099
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 10712 - protein, 173 aa, Mesorhizobium loti MAFF303099
MPKTKKVDRETLPYRPCVGLMILNGEGLVWVGHRIAEPDSEFAGTTQLWQMPQGGIDKGEEPLQAAERELYEETGMRSVSLLAEAPDWINYDLPDHLVGIAFKGRYRGQMQKWFAFRFHGDGSEIQINPPPGGHTAEFDKWSWRPMQDLPDLIVPFKRKVYEEVVAAFSHLAR

SEQ ID NO: 10713 - protein, 473 aa, Mesorhizobium loti MAFF303099
MLQVRQDVLGERFRLQRAAFEKQPFPDPSVRKDRLKRLLALTEHHEADICAAIDADFGGRSAHETRLAELFVVRAGIRHTLSHLSGWMRERRVATTLPFLPGRNRLLPQPLGVVGIVSPWNYPFQLAVAPVTAALAAGNRVLVKPSELTPAFSALLARLAGEHFAPDELSVITGDAEMGKAFVSKPFDHLLFTGSTAVGRQVAIAAAANLTPVTLELGGKSPAIFDPSCDLDAATASIAYGKLLNAGQTCIAPDYLLVPKGQAGTVAAKLATAVAQLYPTLRDNPDYTAIISERHFQRLRAMIAEARDAGADVVEINPAGEDFGAASRKLLPTLVSNAGPDLRLMREEIFGPVLPIIEYATIDEAISHVNQADRPLALYWFGKDSTNRQRILRETVAGGVTINDCMLHLVQENQPFGGVGASGMGAYHGEWGFRTFSKEKPVFLQSRLSAGALLRPPYGKTFERLFGLLRHIT

SEQ ID NO: 10714 - protein, 507 aa, Mesorhizobium loti MAFF303099
MEEDNMHFSPDRPTFFVNPDYRQMADTSKPVIDPATLETVGAIASASDGEIDAALAAATKAQAAWKRLDAKSRAKHLHAVANAIEAADFTRCAELMVREMGKPYPEAIGEIANCAPIFRYYAEMARDDAGKVAGTTQAGSFQYARYEPYGVSVHIMPYNFPILLMCWTVAASLAAGNACIIKPAEATTLSTLDYMAVFRSLPEGLVSCLPGGAATAQALITSDRTHAVAFTGSVAAGKAVAVACAERMKPCVIEAGGSDPLIISKHAPLEVAAAGSVTAAFHLTGQVCTSAERFFVVDAVHDRFVELFAERTRALRIGNGMDKTEIGPLVSEAARAKVMRLVDDAIAHGAKAVTGGRIPPSHNTGWFYEPTILTGVTPDMAIVREECFGPVAAICRVKDFDEAIRLANDSLFGLGASVFTTDLAEAHEAAERLEAGMVWVNNPLIDNDALPFGGWKASGLGRELGRQGLDAFRRSKMVIIDHRPAIQDWWYPYPDSWFRETGGRKHV

SEQ ID NO: 10715 - protein, 338 aa, Mesorhizobium loti MAFF303099
MQIGMMGLGRMGANMVRRLMRDGHECVVYDINPASVAALVSDGALGAASLTEFVGKLAKPRCVWLMLPAAITGKIIDQVSALMEPGDIVIDGGNSYYHDAVNQAAKLAAKGIHLVDVGTSGGVWGLERGYCLMIGGPDVAVQHLDSIFATLAPGADAGAPAPDKAAGTAPFGYLHCGPSGAGHFVKMVHNGIEYGVMAAYAEGMNILKSANAGKRQRTADAETSPLENPQYYQFDIDLPQVAEVWRHGSVIGSWLLDLTAGALKSDPGLAQFGGRVSDSGEGRWTLKAAIDTGVPAPVLSSALFDRFSSQGESEFADKLLSAMRYAFGGHVEKPKAGK

SEQ ID NO: 10716 - protein, 468 aa, Mesorhizobium loti MAFF303099
MAYDVVIIGSGPGGYVCAIKAAQLDLKVAVVEKNATFGGTCLNIGCIPSKALLHASEMFAEAGHSFDTLGVEIPAPKLNLTKMMAHKDATVASNVNGVAFLFKKNKIDSFRGTGKVVAAGKVSVTGEDGKVEEIETKNIVIATGSDVAGIPGVKVDFDEKIIVSSTGALSLDKVPGHLVVVGGGVIGLELGSVWARLGAKVTVVEFLDTILGGMDGEVSKQFQRMLSKQGFEFKLGAKVTGVAKAKKGATVTFEPVKGGAAETIAADVVLIATGRRAYADSLGLKEAGVEVDERGRVKTDGHLKTNVPGIYAIGDVIAGPMLAHKAEDEGVAVAETIAGQAGHVNYEVIPSVVYTSPEIASVGKTEEELKKAGIDYKVGKFPFSANGRARAMLHTDGFVKILADKASDRVLGVHIVGFGAGEMIHEAAVLMEFGGSSEDLARTCHAHPTMSEAVKEAALATFFKPIHI

SEQ ID NO: 10717 - protein, 464 aa, Mesorhizobium loti MAFF303099
MKEISCKLLVIGAGPGGYICAIRAGQLGVDTVIVEAGKPGGTCLNVGCIPSKALIHAAEEFEKVAHMAGGKSPLGISVSAPVLDLGKTIAWKDGIVSRLNSGVAGLLKKAGVKTVHGWAMFRDGKTVEVETETGSQVIRAETIVIATGSAPVELPFLPFGGPVISSTEALALSVVPKKLAVVGGGYIGLELGMAFAKMGAEVTLVEALPRVLAQYDAELTRPVVKRLAALGVEVMTEAKAKGLSTKGDALLVETADGKNTKVSADKILVTVGRKPVTEGWGLDQIDLDMSGKFIRIDDQCRTSMRGIFAIGDVTGEPMLAHRAMAQGEMVAEIVAGHKRNWDKRAIPAVCFTDPELVTVGLSPEEAKAQGEIKIGLFPFAANGRAMTKLGEDGFVRVVARADNHLVLGIQAVGQGVSELSTAFGLALEMGARLEDIAGTIHAHPTQGEGFQEAALKALGHALHI

SEQ ID NO: 10718 - protein, 319 aa, Mesorhizobium loti MAFF303099
MTADRHHGKYETRLDPALWAYIDRVDAWYPPEVIGLPIDKQRAVYDRMCRAFHQGRPPGVKASDGLVAAPGHGIPIRHYRPAGKAARAMVLYFHGGGFILGNLDSHDDICAEICAGTGFDVLSVDYRLAPEHVHPAAFDDAMAAFAWAAETSRLPLVLCGESAGGNLAAAVAQATRKHARTAVGQVLIYPGLGGDEGAGSYVEHAEAPLLSVGDIAFYRDVRSAKRQSPDDPTFSPLRDRHFSGLPPTVIITAECDPLSSDGETYRDRIAAAGGKAWWHEEKRLVHSFLRARTTVPAAAEAFSRIIAAIAALGRGEWPY

SEQ ID NO: 10719 - protein, 479 aa, Mesorhizobium loti MAFF303099
MSEHGKAAPGSAPSDGQSARLRPPYKSVLDLIGQTPVVELTKFDTGKCRLFIKLESQNPGGSIKDRIALSMIAAAEREGKLKRGGTIVEATAGNTGLGLAQVGIPKGYRIVLVVPDKMSREKIQHLRALGAEVRMTRSDVGKGHPEYYQDMAEKIAAEVPGAFYANQFANPANPLAHETTTGPEIFSQLDGNVDAVVVGVGSGGTLTGLGRYFSKVSPKTEMVLADPVGSVLAPLIKTGKMEEAGSWTVEGIGEDFVPPNADLSLVKKAYSISDKQSMLAVRDLLSREGILAGSSSGTLLSAALRYCREQTTPKRVVTFVCDSGNKYLSKVFDDFWLAEQGLAEHEQHGDLRDLVMRSHRTGDTVYVGPDESLLNAYGRMRRSDVSQLPVLEDGKLIGIVDESDILAKVDGPYDGRWERFNGPVRTAMTSNLHTLQASQTLDALLPVFDRNEVAIIFDGDEFVGLITRIDLINHLRRAR

SEQ ID NO: 10720 - protein, 243 aa, Mesorhizobium loti MAFF303099
MGAPAQSTEIRMHGSITARCRRLTLVSAAALALTIIPYRISLHGSAPGIDAASAQAAKGGNGGGNGGGNGGGNGGGNGGGNGGGNGGGNGGGNGGGNGGGNGGGNGGGNSGGNGGGDSGGNSGGNGGGNGGGNSDGNGGGDSGGNSGGNGGGNSGNSGGGNSGTEGGGETSGLGKGQVDKGVSHVNGTTGDKVEVSDNKITVTHPDGITEKIENGRFKMKDALGRTIIDRRATPADVSRLKAL

SEQ ID NO: 10721 - protein, 326 aa, Mesorhizobium loti MAFF303099
MNKPVTSARVPGRGRIYSSITDTIGDTPLVRLDKFAKEKGVVANLVAKLEFFNPIASVKDRIGVAMIEALEAAGKISPGKTTLIEPTSGNTGIALAFAAAAKGYKLILTMPETMSVERRKMLALLGAELVLTEGPKGMKGAIAKADELAATIPNAVIPQQFENPANPEIHRKTTAQEIWNDTQGEVDIFVAGIGTGGTITGVGQVLKKLKPSLHVVAVEPEASPVLSGGQPGPHKIQGIGAGFAPKILDTTIYDEIIKVSNEDSVANARLVARLEGVPVGISSGAALQAAIVVGSRPENKGKTLVVVIPDFAERYLSTILFEGLGA

SEQ ID NO: 10722 - protein, 206 aa, Mesorhizobium loti MAFF303099
MSRTLVLVRHGQSEWNLKNLFTGWRDVDLTEQGHAEAKAAGQKLKARGLKFDIAFTSALSRAQKTCQHILDAVGQSDLKTIRDQALNERDYGDLSGLNKDDARKKWGEEQVHVWRRSYDVSPPGGESLKDTGARVWPYYLHDLQPHVLRGGTVLVAAHGNSLRALIMALDGKSGEEIVKLELGTGVPVIYQLNADSTVASKEVLEG

SEQ ID NO: 10723 - protein, 362 aa, Mesorhizobium loti MAFF303099
MLNRQKIRTTAGRGRLFDSILDTVGDTPVIRVNNLGPAHATVYVKAEFFNPAASVKDRLALNIIEEGERSGALKPGQTVVEATSGNTGIGLAMVCAQKGYPLVVTMADSFSVERRKLMRMLGAKVVLTPRAEKGFGMYKKAVELAEANGWFLARQFETAANAAIHEATTAREIINDFAGSRLDCFVTGYGTGGTVVGVARVLRRERPDTRIVLSEPANAQLIGSGKAQQRGAHGAPAASHPAFEPHPIQGWTPDFIPNVLQEAIDASLYDEVMPIAGPEGIKWAKALAQKEGIFTGISGGATFAVARQVAEKAPAGSVILCMLPDTGERYMSTPLFDGIEAEMDAEEMALSRSTPGGQFPAA

SEQ ID NO: 10724 - protein, 376 aa, Mesorhizobium loti MAFF303099
MKADFYETLGVQKGADEKELKSAFRKLAMQFHPDRNPGDHSCEHKFKEINEAYETLKDPQKRAAYDRFGHAAFEQGGMNGGAQGFGAGGFADIFEDIFGDMMGGRQRRSSGGRERGADLRYNMEISLEEAFAGKTAQIRVPASISCTECSGSGAKPGTQPVTCSMCHGHGKVRATQGFFSIERTCPQCQGRGQTIKDPCPKCAGQGRVTEERSLSVNIPAGIEDGTRIRLANEGEAGLRGGPSGDLYIFLAVKPHEFFQRDGADLYCKVPISMTTAALGGSFEVTTLDGTQTKVKVPEGTQNGRQFRLKGKGMPVLRQPNVGDLYIQTAVETPQNLSRRQRELLEEFEQLSSQDNSPQSSGFFARMKDFFESFGER

SEQ ID NO: 10725 - protein, 225 aa, Mesorhizobium loti MAFF303099
MSTKTLIAPSVLASDFSKLGDEVEAVAAAGADWIHLDVMDGHFVPNITFGPPVIKAIRNRTKAFFDCHLMIAPADPYLAAFAEAGCDGMTVHAEAGPHLDRSLQTIRNLGKKAGVSLNPATPETMIEYVLDRLDLILIMTVNPGFGGQAFIPGIVDKVRRVKALIGDRPIRIEIDGGVSPETAPLVTAAGADVLVAGAAIFKGGSVEAYRANIEAIRTAADKAAG

SEQ ID NO: 10726 - protein, 504 aa, Mesorhizobium loti MAFF303099
MSNHLFDAFRSRMPAPGHLLMETDDGRSLSYGDMLARSAQFAHALLQLDVEPGDRVAVQVEKSPEALLLYLACVRAGAVFLPLNTAYTLTELGYFFGDAAPRVIVCDPARAADIGRMVEPSGAVVVTLDRNGRGSLADQASRLPSDFHDVARGPDDLAAILYTSGTTGRSKGAMLSHENLASNARVLVEQWRFTSGDVLIHALPIFHTHGLFVATNVVLMAGAAMLFEQKFDPARIVALLPRGTALMGVPTFYVRLLQQDGLDRQAAKTIRLFVSGSAPLLADTHKAWRERTGHAILERYGMTETNMNTSNPYEGERRAGTVGFPLPGVALRIADPDTGKPLAQGEVGMIEVKGPNVFGGYWRMPEKTKAEFRADGFFITGDLGMVDTDGYVHIVGRGKDLIISGGYNIYPKELESEIDALDGVSESAVIGVAHPDFGEGVTAVVVRAPGAAITGAEVLGAIAGRLARYKHPKQVIFVDELPRNTMGKVQKNLLRDAYKDLYTS

SEQ ID NO: 10727 - protein, 331 aa, Mesorhizobium loti MAFF303099
MFDPKFRKVADKIFSKSGTRLAPYSGIPTFLAAPYREIAAENPNFGDLQVAIIGVPMDLGVTNRPGSRFGPRALRAIERIGPYNHVLECAPTHELRVADIGDTPFRSRYRLETSHEDIERRTNQIVDAGVIPLSVGGDHSISHPILKAVGKKAPVGLIHIDAHCDTSGLFDMTKFHHGGPFRNAVLDGVLDPTRTIQIGIRGSAEYLWEFTYESGMTVVHAEEVTGLGIPAIIEKARKIVGDGPTYVSFDIDSVDPAFAPGTGTPEVGGLTTREVLELLRGLKGLNIVGGDVVEVAPQYDATTNTAHAGAQVLFEILSLMVFSPAITGKGA

SEQ ID NO: 10728 - protein, 467 aa, Mesorhizobium loti MAFF303099
MSAIDAGARAPENLWRQEIRATLALAWPMVLTNLGQTAMTATDVMMMGRLGPDTLASGALGANLYFMPLIFGLGLMLATSPMIATELGRRRYSVRDLRRTVRQGLWLAILISIPIWIVLWHGEAILLAMGQEPALAHQAGIYLRWLEWAVLPFYGYIVLRSFISALERPGWALIIVFVAVACNALFNWVFMFGNLGFPAMGIAGSGLATSLSSTLMFAGMAAVVMLEKKFRRYRLFGRFWRSDWPRFNGLLRLGLPIAGILAFEVTIFNAAALLMGLIDADSLAAHAIAIQIASISFMVPLGLNQAVTVRVGLAHGAGNPEGVSRAGWTAFVIGVSFMALMGLVMVLWPHLLISAFIDLANPANARVIALAVSFLVFAALFQVFDGAQAVAAGMLRGLHDTKVPMIYAAIGYWGVGLPLGVLLAFHFGFHGVGIWIGLSSGLAVVAALLLTRWLRRDRIAPPLAFGH

SEQ ID NO: 10729 - protein, 412 aa, Mesorhizobium loti MAFF303099
MTEMARGMVIIGAGECGGRAALTLRDLGYDGPVTLVGDEPHLPYERPPLSKEAMASDAPEIKAIASDAVLAERSIRHIHSVQAAAIDRAAHSVRLSDGSVLPYDKLLLATGATPRKLSMPGLGARCVYLRTFADALAIRGHLRAGSRIAVIGGGFIGLELAAASRRLGAAVTVIEAQPRILMRGVPAEIAEIVHDAHIAEGVDIVCGQGIASIADDGRQVRVTLAGGREVSADLAIIGIGAVPVTGLAADAGLMIDNGIAVDAELCSSDPDIFAAGDCCSFPLAVYGGRRVRLEAWRNAQEQGALAAKNMLDAGEAHAAVPWFWSDQYGLSLQIAGLSDEGKNTVRRDLDDGAFILFHLAEDGTLVAASGIGPGNAVARDIRLAEMLIGKRAKPAPEALGSQAVKLKSLLAA

SEQ ID NO: 10730 - protein, 312 aa, Mesorhizobium loti MAFF303099
MTDYTKLIDAETWAFIERTNSYYPPDTIDYTITQQREIYDRMCREFFAGYPQGVTVETSAIATPTHDIPIRIYRSAPQPAATVLCIHGGGFMLGGLDSHDDVCAELCARTGYEVVSVDYRLAPEHLHPAAFDDAMTAFAWVASTRDRPILLCGDSAGGNLCAAVSHATRGHVKRPVGQVLIYPGLGGDRSKDSYVTHAEAPMLTMRDLEFYKHIRTGGQDRSGDATLAPLADTDFANLPPTVLVTAQCDPLSSDGETYRDRIIAAGGRATWFEEPGLVHGYLRARHTVGRARESFTRIVGAAAALGQGAWLW

SEQ ID NO: 10731 - protein, 332 aa, Mesorhizobium loti MAFF303099
MMQTRKLGTELNVYPVGLGCMGMSFAYGGQPEAEAISTLHRAVEIGVNFFDTAEVYGPYENEILLGKALKSMRDKVTIATKFGFKILEEGTGLDRMAGVDSRPEHVKAVAEASLKRLGTDVIDLYYQHRVDPNVPIEDTVGAMAELVREGKVRALGLSEASAATIRRAHAVHPIAAVQSEYSLWTRDPEEEVFAVCRELGIGFVPYSPLGRGLLTGTIAKPETLDDGDWRRTLPRFQAEAMEANAKVIATLETMAAEKGVTSAQLALAWVLHQGDFIVPIPGARKIRHLEQNTAAAAIELSAAEVAAIGDALSPDKVMGKRYTEELLALVNG

SEQ ID NO: 10732 - protein, 279 aa, Mesorhizobium loti MAFF303099
MTTRIDRRMAKLKTEGRPALVTYFMGGDPDYDTSLSIMKALPGAGSDIIELGMPFSDPMADGPAIQAAGLRALKGGQTLVKTLKMASEFRAGDNETPIVLMGYYNPIYIYGVDRFLKDALASGIDGLIVVDLPPEMDEELCIPALKAGINFIRLATPTTDDKRLPKVLQNTSGFVYYVSMTGITGSALADTGKVAAAVNRIKGHTDLPVCVGFGVKTAEQARVIGANADGVVVGTAIVNAVANVLGPKGEKTADPAEAVATLVSGLAQGVRSARLAAAE

SEQ ID NO: 10733 - protein, 308 aa, Mesorhizobium loti MAFF303099
MNWITNYVRPKINSMLGRRTDMPENLWIKDPETGEMVFHKDLESNQFVIPSSGHHMKISAKERLKYFLDDGRYEQLENPKVVLDPLKFRDEKRYTDRLKDAKAKTGLEDAIVNALGTIEGLPVVVTVQDFAFMGGSLGMAAGDAIVHAFEVALQRKRPLILFAASGGARMQEGILSLMQLPRTTVGVDRLKEAGLPYIVVLTNPTTGGVTASYAMLGDVHIAEPGALIGFAGPRVIEQTIREKLPDGFQRSEYLMEHGMVDMVVSRLEMRQTIARLLKMLLKMPGEQKPLEPEILPPAVVAAEARPQA

SEQ ID NO: 10734 - protein, 466 aa, Mesorhizobium loti MAFF303099
MDNAIVTSPSGSSPAEAQAFLDAHPEIEAFDIVLTDANGVGRGKIVRRHELKSIFEGGRHMPISILGLDITGEDVHETGLIWTTGDGDLRAWPIPGTLVPLYGTNPPRGQVLMAMYHLDGQPMSSDPRLALARQVDILAAKGLYPAGAFELEFFLLANERDADGKVQPARAVLDGRVSGKTEVYSVDHLHGMEPLFSDIYAAAKAQGIPAETVISEYAPGQYELTLNYRKDVMRAADDLVMLKRLVRAQARRHGVTACFMAKPIEKYAGSGMHFHVSLQDKAGRNVFAEAGGESWSLPLLQGLGGLIQTMAESMLVFAPHANSWRRFVSQSYAPVAPTWGVNNRSVALRVPAGDAKNRRIEHRPSGVDANPYLIAATVLAGIVKGLDEGLDPGPETTGNGYEAAVTRTTMPADWRAAIEAAKASSFLKGALGEDLHRTFVAIKQSEYLRVARTVSELDYHLYLHEV

SEQ ID NO: 10735 - protein, 460 aa, Mesorhizobium loti MAFF303099
MHNSDSSKTPIGGISRDRIAQLRETEGAAFRKARPKSQAKVGNGLPGFFGGVPMHWMNDWPTPFPILVDSAKGAAITDIDGNRLDDFCLGDTGSMFGHSPPPVARAIRRQAGRGLTYMLPSEDALAIGPLLQQRFGLPFWQIATTATDANRFSLRVARAVTGREKILVFNGCYHGSVDETMVRLIGGKPVNRPGLAGEFRDLTRTAKVIEFNDVAALEAALKDRDVACVIAEPVLTNSCMVLADPGFHDALRRLTRETGTLLLIDETHTISTGPGGYTRKYGLEPDFFVLGKPIAGGVPASVWGMSDEVASRYADYNRTKEPGYSGMGTTLSANPLQFAAMRATLEEVMTAENYDRMDHLAERLDAGLTGVIDRYRLPWHVARVGARVEFICAPGPLRNGAEAETAHAPELEAAIHVALVNRGVLIAPFHNMMLISPATSGAQVNRLIAAFGAVAAKLAA

SEQ ID NO: 10736 - protein, 455 aa, Mesorhizobium loti MAFF303099
MDTQPAPFVPPAPKPRTSPPSTLEMIRIVYRNPLELWGEPTYNEPWISANGVGGHLIVANDPGLIRHVLVDNAKNYKMATVRQKILRPILRDGLLTAEGEVWKRSRKAMAPVFTPRHIFGFAQPMLKRTKEFVTRYEEGGASDIAHDMTLLTYDILAETLFSGEIAGEPGSFANEIDRLFETMGRVDPLDLLRAPDWLPRLTRIRGRKTMAYFRKIVTDTVKMREEKFRRDPDAVPQDFLTLLLKAEGPDGLTRSEVEDNIITFIGAGHETTARALGWTLYCLAESPWERNRVEQEIDEVLAREPDPTKWLDAMPLTRAAFDEALRLYPPAPSINREPIEPEMWKDLYIPRHAAVLVMPWVVHRHRKLWDRPDAFLPERFHPGNREKIDRFQYLPFGAGPRVCIGASFAMQEAIIALAILLSRFRFDTTAETKPWPVQKLTTQPQGGLPMQVTPR

SEQ ID NO: 10737 - protein, 479 aa, Mesorhizobium loti MAFF303099
MAQFRKNLIDGEWVGDAGSHNINPSDTGDVVGEYASAGVEQAKQAIAAAKAAFPSWSRSGPLARHAVLKKASDEIMARKDEIGRNLAREEGKTLAEGIGETIRAAQIFDFFAGETLRLTGEMVPSVRPGVGVEITREAVGVVGIITPWNFPIAIPAWKIAPALAHGNTIVFKPAELVPESAWSIVDILHRAGLPKGVLNLVMGKGSVVGQAMLDSPDINAITFTGSVGTGKRVAAASVEHMRKFQLEMGGKNPLVVLDDADLAVAVDCALNGAFFSTGQRCTASSRLIVTEDIHDRFVEALKERMGKLVIGDALDAQTQIGPVVDATQLKQDEDYIAIGVREGATLAFGGERLDRKTPGFYLSPALLTEATNAMRSSREEIFGPVASVIRVKNYDEALSVANDTPFGLTSGICTTSLKHATHFKRNSEAGMVMVNLPTAGVDFHVPFGGRKGSSYGPREQGRYATEFYTTVKTAYTFAG

SEQ ID NO: 10738 - protein, 509 aa, Mesorhizobium loti MAFF303099
MAREQTKAATFPVDRNDVELVRGAHPPRWKNPTPDGPYNLVVIGAGPAGLTAARDAASLGAKVALIERGLIGGACVNVGGVPSKSIIRTARLYADMRDAENFGGDTPARLPVDFERAMMRMRQIRQRLSRADSAAAITAEGIDLYFGEARFGGPDTVEVAGKTLHFKKALVATGAHPSGPAIPGLAEAGYLDNESMFNLTRRPERLLVIGGGPLGCETAQAFCLLGAKVILAQSDPMFLPGEERDAAQILSDTLAREGVEVRLNTEVVAVRKEGGRKLADLLRDGDTTTISVDEIITGVGRSPNVRGLGLEEAGVVYDANGIKVDDHLRTTNPHIYAAGDVCLEYKFTHTAEAAARIVVRNALFRGRERLSDLVVPWCTYTDPEIAHVGLYPIEARQNGIPVKTYTVLMHDVARAVMDGEEEGFVKIHVREGSDRILGATVVASHAGEMINAVTLAIRSGMGLHALADVIHAFPTQAQGIKMAGDAYRRTRFTSLRRRLAARWLAWSRR

SEQ ID NO: 10739 - protein, 475 aa, Mesorhizobium loti MAFF303099
MDTQMLIGSKFENGAETEESILNPKTGATILNLPEASQAQIEAAVAAAEKAFVSWSRTTPAQRSGYLLKIADRIEAEAKEFAALEALNCGKPINSVLNDEIPAIVDCYRFFAGAVRSMPGVVAGEYLPGHTSMVRRDPIGIVASIAPWNYPLMMMAWKLAPAIGGGNTVVFKPSEQTPLTALRLARILAEILPEGVVNVVLGRGDSVGNALINHPKVNMISITGDVATGKKVLQAAAKSVKRTHLELGGKAPVIVFDDADLGAVVNGLRAFGYYNAGQDCTAACRIYAGKKIYDKLVADLSSAVSTIKYNQPDDTENEIGPLISRRQRDRVSSFVERASELKHIEITTGGRPGEGTGFYYQPTVVAGALQEDEIVRREVFGPVVSITRFTEVDEAVNWANDSDYGLASSVWTKDVSRAMATAARLQYGCTWINTHFMLTNEMPHGGLKQSGYGKDMSLYALEDYTAVRHVMVAHA

SEQ ID NO: 10740 - protein, 369 aa, Mesorhizobium loti MAFF303099
MFAPFKLRDMKLQNRVVVSPMAQYKAVDGCPTDWHFTHYAERAKGGAGLIYIEMTCVSPEGRITPGCPGFYAPEHEVAWKRLVDFVHSETEAKICAQIGHSGAKGSTRLGWEGTDVPLASGNWPVMAASAVAWSPENQVPKAMDRADMDLVRNQFVVSAEMAERCGFDMLEIHAAHGYLLSSFITPVTNRRTDEYGGSLENRMRYPLEIFHAVRAAWPAEKPISMRISANDWVGIEGVTPADAVEIARLLHEAGVDICDVSAGQTSVSAKPIYGRMFQTPFSDRIRNEVGMATMAVGNIYEPDHVNSILMAGRADLVALARPHLADPYWTLHAAVTLGDRGVKWPDPYLPGRDQIYRLAERDAAAGLKV

SEQ ID NO: 10741 - protein, 287 aa, Mesorhizobium loti MAFF303099
MPEKTNRISFQGEPGANSDTACRNVYPSMEPLPCPTFEDAFNAVETGKADLAMIPIENTIAGRVADIHHLLPESRMHIVGEYFLPIHFQLMVLPGVKRDEIKTVHSHIHALGQCRKYIRKNGWKAVVAGDTAGAAKMISEVKDRTMAALSPALAATLYGLDIIEENVEDTDSNVTRFVVLTKSKQWAERPSPDVKMMTTFIFRVRNVPAALYKAMGGFATNGINMTKLESYQLGAFTATLFYADIEGHPDDPLVKLALDELRFFSREVRILGVYPASESREQWKVAD

SEQ ID NO: 10742 - protein, 429 aa, Mesorhizobium loti MAFF303099
MKDIMKNSAISERKNQSISRGVGMTTQIYADRAENSEIWDVEGRRYIDFSSGIAVVNTGHRHPRVIEAVKAQLDRFTHTCHQVVPYESYVRLAERLNAMLPGKFEKKTIFVTTGAEAVENAIKIARNATGRPAVIAFAGGFHGRTFMGMALTGKVVPYKVGFGAMPGDVYHAPFPVPLHGVSVADSLAALDRLFKADVDPARVAAIIVEPVQGEGGFYEAPREFLTALRKLCDQHGMLLIADEVQTGFARTGKMFAMDHHEVAADITTMAKSLAGGFPLSAVTGRAEIMDAPGPGGLGGTYGGSPIGVAAAHAVLDVIEDEKLCDRANTLGARLKQRLQSIRDDVPEIVDIRGLGFMNAVEFNDVKKGMPSAEIANAIRLKALDKGLILLTCGVYGNVIRFLAPITIQDEVMNEALDILESSIREVCAA

SEQ ID NO: 10743 - protein, 417 aa, Mesorhizobium loti MAFF303099
MKNGVVIVGAGHAGVQAAASLREDGYDGPVILIGDENELPYHKPPLSKTFIKDAEAKPQPLRGEAFYTGSVIDYRPGVRIERIDAGGHSLEISGGGVLAFDHLILATGSRPRLLPLPGSDLSGVLSLRSLADARLIRDLSARSEDVVILGGGFIGLEIAATLRAAGRTVTVVEAVDRLLGRAVAPVVASHVRQRLEATGVRILTGTSIARLEGENGHVVAAITSSGEKLPARMVIVGIGAVPNVELAQDAGLTIANGIRVDHQMRSSVQDILAIGDAASYRHWFTGGDVRLESVQNATDQARLAARTITGHADAYSAVPWFWSDIGDMKLQMVGLTAGGDSHVVLGDLPDNKFSIYHYAGDRLLGIESVNRPGDHMLGRKMLGAGFSPTPEMVAAGPDGLKAALAAFQQDEPARAAG

SEQ ID NO: 10744 - protein, 399 aa, Mesorhizobium loti MAFF303099
MSGSALYETFARAPLAFDHGEGTWLVTDKGERYLDFAGGIAVNSLGHSHPHLVAALTEQAAKLWHVSNLYEIPGQSRLGQRLVDATFADKVFFTNSGAEALECAIKTARRYHFVKGHPERFRVITFEGAFHGRTLATIAAGGQYKYLEGFGPKVEGFDQVGFDDIDAAEKAITPETAAILIEPVQGEGGIRPVPTQSLKRLRQLCDQHGLLLIYDEVQCGIGRTGKLFAHEWSGVAPDIMAIAKGIGGGFPMGACLATDEAAVGMTAGVHGTTFGGNPLAMAVGNAVLDVVLEDGFLEDVQRKALLMKQGLAAIADEFPDVVEDIRGTGLMLGLKCAMPNTKVNMALRDQHLLAVPAGDNVIRLLPPLTVTDAEIHEALNRIRAGAKGLADAIAVAAAK

SEQ ID NO: 10745 - protein, 495 aa, Mesorhizobium loti MAFF303099
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 10746 - protein, 471 aa, Mesorhizobium loti MAFF303099
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQALQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 10747 - protein, 497 aa, Mesorhizobium loti MAFF303099
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 10748 - protein, 422 aa, Mesorhizobium loti MAFF303099
MMPQSRVWHPFTQHALEPAIPEIARTEGAYLYKADGTRILDAISSWWVVTHGHRHPRIIKAIETTASSLVQIIFAGFTHEPAERLAKALVGLAPAGLDWVFYSDSGSTSVEVALKMALGYFRNIDAPRSRIVVMEHSYHGDTIGTMSVGARGAFNAAYEPLLFEVDTIPFPAAGREQETLDRFEAVARDRRTAALIVEPLVLGAGGMLMYPAWVLAELKKIAETSGTLLIADEVMTGWGRTGTMFACEQASISPDILCTSKGLTGGAIPLAATLATDAIFQAHYSEDRKKTFFHSSSYTANPIACAAALANVEIWRDEPVAERVAALSAKQAAGLQRFRDNPYFTDCRATGTIAALDLRTGSAGYLAEIGPKLRAFFLERGLLVRPLGNVLYLLPPYCITGGELDALYDAIEEAAERFGSRP

SEQ ID NO: 10749 - protein, 337 aa, Mesorhizobium loti MAFF303099
MLEKFERYPLTFGLTPIEKLDRLGKHLGGKVEIYAKREDCNSGLAFGGNKLRKLEYVIPDAIASDADTLVTVGGVQSNHTRMVAAVAAKIGMKCLLVHESWVPHEDVVYDRVGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPAGSRILYAHLGGAPAINGYGYTFRNG

SEQ ID NO: 10750 - protein, 458 aa, Mesorhizobium loti MAFF303099
MRHQILSNRSGEDLRASDLAHHLHPFTDHTVLAAEGGPRVIKDGDGIYVWETEGRRLLDGMAGLWCVNVGYGRKELGEVARQQMDRLAFYNTFFKTSHEPVINLAERLAAVTPEGIDNFFFGNSGSEANDTAIRLVRSYWAAVERPERQVVISREYAYHGSTLAGASLCGLPGMHGVAGLPIPGIAHAAAPYAWAAGKDQDDPAYGRASADALEAKILEIGPKNVAAFIGEPVMGAGGVITPPPRYWARVQEICRKYDILLVCDEVICGFGRTGEWFGAQSFGIAPDIMCMAKGLSSGYIPISAVGVGTRVAEILRTRPGVLSHGFTSSGHPVAAAVALKNIELIEAEGLVNHVRDVAGPALARRLGALAMHPLVGQVRGIGAMWALELTSDKATRAPFAPLGSVATRVRNLCFERGLATRAVREGLVFAPPLIITEAQVDEMADILTSCLDTAVAEL

SEQ ID NO: 10751 - protein, 440 aa, Mesorhizobium loti MAFF303099
MSHVFHRSALSVPPMAVAADGHYIIDINGRRYLDASGGAAVSCIGHGDPRVVAAVAEQIARLDYAHSGAFTSPSAEELAAHICAEAGQGMARVYFVGSGSEAVEAAIKMARQCQIERRQPSRHVVISRRLSYHGNTLGALGRSGSETRRAPYAPMLQKRTQIAPCFPYHYAEPGETPEAYGLRAAEALEAEILRLGSENVAAFLAETVVGATSGAVVPATGYFRHIREICDRYGVLLICDEVMCGAHRTGPFLACSDEGVSPDIVTLAKGLGGGYLPIGAVVCRADVHDSFAQGSGAFTHGHTYMAHPVACAAALEVQRVIVDDRLAERVVRQGALLDAALRDRLSQHTYVGDIRGRGLLYAVELVADRETRVSFDPEMRLAARIGAQAKGRGLLVYPGSGTIDGLRGDHVLLAPAYSIDAQRVGEIADILTEAIDAALG

SEQ ID NO: 10752 - protein, 481 aa, Mesorhizobium loti MAFF303099
MEHAMFDARTYELFINGKWRAGGSKATLPVINPATEKVFASVASATVSDLDEALASAERSRKAWSSRPAKDRGEILVAAARILAEKAAAAARDLSAEQGKTIAEATGEYARAVETLEWNGRNVEELSASIPLGPNRMIVPEALGVVAAFTPWNYPAVLIARKLAPALAAGCPVILKGAEETPSVAVHIVESLRQAGIPDGVVNLVFGIPVHISRHLLSSPTVKVLTFTGSTAVGKQLAMLAANNLQRCILELGGHSPVIVCEDADLAKAIPAISEYKFECAGQSCNAPSRILVARSLYEQFLSRMTDAARKIKIGAPDDPATEMGPMANARRIEAMQRLTKDAVDRGARIETGGTRLDGPGFYWPPTILTGVPKDARVLHEEPFGPILTVAPFDTLEEAIEEANATEYGLAAYFFTGAADAQQKLINSLSAGAVSVNYLKGVSADAPYGGVKQSGYGYEGGEQGVRSFQILKMVNGLSSFG

SEQ ID NO: 10753 - protein, 468 aa, Mesorhizobium loti MAFF303099
MRLSNLGTEQLREKDRSFVFHPSTHLAKHSRGETPNRIMAGAEGVYIWDTEGRKSLDGFGGLYCVNMGYGCTEIAEAIARQAHELPFAHVYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSTRCADELEGLILAEGPETVAAFIGEPVLGTGGIVPPPKGYWTAIQGVLDKYDILLIADEVVCGFGRTGEQFGSHLYGMRPDFVTIAKGLSSAYLPISGSIIGDRVWSVLEQGTEKHGALGHGWTYSGHTLCAAAALANIRLLKERNILEHVRDVGPYWHARMNAELAGHPIVGEVRGVGILAAVELMRDPKQRIPFESDLQVGVRAAAALFENGVIGRAMPHGDILGFAPPLIITRKEIDIIVDATAKSVETTYRALKAEGAI

SEQ ID NO: 10754 - protein, 387 aa, Mesorhizobium loti MAFF303099
MIKGESLQLRRVCKQYGDYHAIKDVSVQIEAGEFVSFLGPSGSGKTTTLMMIAGFETPTSGEIIVGDRAITSLPVHRRNIGVVFQNYALFPHLSVFENVAFALKMRAVARDEISRGVAEALNLVQLSGYETRMPHELSGGQQQRVALARSLVFRPGVILMDEPLGALDKQLREHMQVELKRLQRSLGTTVIFVTHDQSEALTMSDRIVVMNEGRIAQVGTPEEIYEAPSSRFVASFIGESNFLQATIIEASKNGPLLDVHGLRVRATWAQGKRPKGSAGTLMVRPEKIIPLGSSGKADNEFEGVVQEAIYWGNIIKYRVHLREAKSVSLTVALPYHSSSPKFQLNETIRVGWDARDSRLLVDESERQAGNAPEPELLIGQGIERVVS

SEQ ID NO: 10755 - protein, 505 aa, Mesorhizobium loti MAFF303099
MNKVEFSRPVKAPFDKRYGNFIGGKWTEPRSGRYFENHSPVNGQLLCEVARSDADDIEAALDAAHAAKDAWGRTSVAERSLILNRIADRMEENLDLLACAETWDNGKPIRETTVADLPLAIDHFRYFASAVRGQEGSLSQIDDDTVAYHFHEPLGVVGQIIPWNFPLLMACWKLAPALAAGNCVVLKPAEQTPAAILLWADLIGDLLPPGVLNIVNGFGLEAGKPLASSPRIAKIAFTGETTTGRLIMQYASQNLIPVTLELGGKSPNIFFKDVVAEDDDFFDKAIEGFVMFALNQGEVCTCPSRALIHESIYDRFMERALKRVEAIVQGDPLDPATMIGAQASSEQLEKILSYIDIGRQEGAEVLTGGARNVLPGDLAGGYYVKPTVFRGHNKMRIFQEEIFGPVVSVTTFKDDDEALSIANDTLYGLGAGVWTRDGNRAYRFGRAIQAGRVWTNCYHAYPAHAAFGGYKQSGIGRETHKMMLDHYQQTKNMLVSYSPKKLGFF

SEQ ID NO: 10756 - protein, 508 aa, Mesorhizobium loti MAFF303099
MAIETARGTIDVSKSNSINLLHSKAVGLAGVLFLAVTGAAPMSAMLGNVPFAAGYGIGKYTPAAFLMATIVLTIFSIGYAAMASRVSSVGGFYSFISQGLGREVGMSAGIGSLACYSLFEASLTGLFAFFGNLWLSQHFGINVPWIVLALAMIVVIAALAYRDVKVSARLLGIALILEVIMLVIFSLGVIFAHGGTNFSGDSLNVFKVFTPVAEQKVGDVAIPAGEAAVGIFMAFWSWVGFEMAPNYAEESRDPKRIIPQSLLISVIGLGLFYTFVSWCAVAAYPTEADMVAKAFSDGVNFFLTPVQSFVGGWGYQLMSLLILTSSFACGMAFHNTASRYLYSLAREGVLPQAIAETHDHHKSPHKASALQSVLAAVWVLLYGLAYGFDDPSGQAWLGVYTLFAVLGTGLLLVLQAVVSLAIYMWFKKNGGGSMLTTVIAPLISLVVQLVLVYTLVANLATLGGTNGFARSIPYVGLAILIVGLIWGFVLKSANPKAYENIGHMVNEG

SEQ ID NO: 10757 - protein, 511 aa, Mesorhizobium loti MAFF303099
MLHDYLAHSARRLGDKVALVCGKQRVTYGELEARANAIATDLAASGVARGDRVMIFADNTVETVVSFWAVLKANAVVCIVNPLTKSDKVDYLLNDCRPAALITDAHLHAIFREPARGCQSLLRMIVSGSIDDPELSRLPRAVRWDTAVGNGGDAPPARRCIDIDLAAIIYTSGSTGEPKGVMLTHRNMMTACTSIASYLELAEDEVILNVLPLAFDYGLYQMIMAFRTGARLVLERSFAFPAQVLGLIRQEGITGFPGVPTIFAALSELRSLKDQDFSSIRYVTNTAAALPLKHILMLRELFSSARIYSMYGLTECKRCTYLPPEDLKRKPLSVGIAIPNTEMWIVDEHDRRVGPGVVGQLVIRGATVMKGYWGKPEATARKLKPGPLPGEQVLYTGDYCRMDAEGYLYFVGRGDEIIKSRGEKVAPKEVENVLMDIPGVREAAVIGVPDELLGQAVKAFVVMENGRTIGEKQLQMECQKRLENFMVPKSIVVVASLPMTDTGKLKKTALS

SEQ ID NO: 10758 - protein, 310 aa, Mesorhizobium loti MAFF303099
MRCKIVGAPVQDGAGRMGCEMGPSALRTAGLAEVLSGLGHTVEDMGAVQPMPARRVVHGNLALKALPEISAWTSAIAAAAYAASEDAMPIFLGGDHSISAGTVSGLARRAAEAGRPLFVLWLDAHPDFHTLDTTASGNLHGVPLAYASGQPGFSGYFPDLPAAVDPKRICTMGLRSVDPAERSALNQAGVTVHDMRAIDEHGIAPLLRAFLARVSDEDGLLHVSLDVDFLDPSIAPAVGTTVPGGATFREAHLVMEMLSDSGLVSSLDLVELNPFLDERGRTATLMVDLTASLMGRRIMDRPTRSHSGSF

SEQ ID NO: 10759 - protein, 225 aa, Mesorhizobium loti MAFF303099
MKTYLAEVLGTFLLVFIGTASVVTGGFGGALPLGQEGIGLAFGIGLIAAAYAIGPISGAHLNPAVTLGVFLAGRLPAKDVIPYWIAQIIGAILASLALWIIVSGQAGGHTGGFGANGWDETKWGMSSAFLWELIGTFTFVTVILGVTAEKHSTAFAGLVIGLTLAGIHFAMIPVTGTSVNPARSIGPALFTGGAALSQLWLFIVAPLIGGAIAGVVAKARIFEKD

SEQ ID NO: 10760 - protein, 466 aa, Mesorhizobium loti MAFF303099
MVEPALSLNETGAPTNERFHLIQAAPLAGSIGAEARELITSSEDIFVTDQSGRKLIDGPAGMWCINVGHRNQALADTLRDQAMSMTYSTPWYTSNAPAEKLAQMLAERAPGDLNHVFLTTGGSSAVETAIRLVQFYNNVRGLPQKKLLISRQGSYHGSTYLTASLNGRPRDHDWMDGAGDLVRKLTCPNPFHRPANLSLEAFEDFLVNEFRALIEHEGAQQIAAFIAEPIQASGGVLMSPPNYLKRMRALCTENDILFITDEVVTAFGRLGHIFASQDVFGIQPDMITFAKGVTSGYFPLGGVMVSDRLLSELRRLNHPKANFVHGLTYSSHPIGCAVAIRNIELLEDGLLHHAREIGPYFQEQLRTLEELPLVGEVRGAGLMAGIECVADAKTEDRLDLDLTVGKRIDFHCQENGLLVRPLINMCVMSPPLTISRSQIDMMTDALRKGIEATADDLIREGLWKPA

SEQ ID NO: 10761 - protein, 496 aa, Mesorhizobium loti MAFF303099
MPSAAEPMARTNNNLTGASMQSDNASKFYIDGQWVMPGGAGRMDVVNPATEQSFMQIAIGTTEDADLAVQAAFEAFPTFSQTSRTERVELLRNVLRCYNDRYDDIARAVSTELGAPLKFAREAQAWAGQIHLESTIAALEAFSFDELHGSSMITWEPIGVCALITPWNWPLNQIVCKVAPALAAGCTVVLKPSELAPLSAIIFAEVLEEAAIPKGVFNLINGTGPEVGQYLAGHPRVDMVSFTGSTRAGIMVAKTAAETVKRVAQELGGKSANIVLADADLENAVVKGVEACFSNSGQSCDAPTRLLIPADRHAEALDIARRVAAATRVGDPSSEDTDMGPVISQQQFDKIQRMIGLGIEEGATLVAGGPGKPEGLDVGFYVKPTIFGGVTPEMTIAREEIFGPVLSIIPYDTEADAIRIANDSIYGLAAYVQGGSLEGARAVARKLQAGSVYVNYAPWDTHAPFGGYKQSGNGREYSHWGIRDFMEVKGIVGWGA

SEQ ID NO: 10762 - protein, 508 aa, Mesorhizobium loti MAFF303099
MTMSTNSKDLSRRLAAGADDAPAILAPDRATLTHGGLRRLIAATAERLHALGIGRGDRVAIVLPNGPEMATAFVAVAAAASTAPLNPAYRADELDFYLTDIGAKAILVAENETGPAVAVAERLGIGVLRLVVQPDTPAGSFTIEGVAIGPQAAPDMAGDGDIALLLHTSGTTSRPKLVPLSHANIAASAAHIGATLGLSADDRCLNIMPLFHIHGLIAAVLSSLAAGGSIYCTPGFNALRFFQWLGDAKPSWYTAVPTMHQAILPRAARNEEILAAARLRFIRSSSASLPAQVMGELEATFGCPVIESYGMTEAAHQMASNRLPPGLRKPGSVGAGAGPEVAVMAPDGRLLTTGETGEIVIRGPNVTAGYEKNPDANATAFAHGWFHTGDQGVLDEDGYLRVTGRLKEIINRGGEKISPLEVDDVLMDHPAVAQVVTFAMPHDKLGEEVAAAVVLREGMIATESDIRSHAATRLADFKVPRKILILDEIPKGATGKLQRIGLAAKLGL

SEQ ID NO: 10763 - protein, 457 aa, Mesorhizobium loti MAFF303099
MLANSLIELDRAHLIHPVSSYRGHEALGVRVLKSAKGATVTEASGRQLVDGFAGLWCVNAGYGHDSIVEAAARQMRELPYATAYFDLGAEPAIRLASELAERAPGDLNHVFFTLGGSDAVDSTVRFVRYYWNARGAPKRDQFISIEQGYHGSSVVGAGLTALPAFHAGFGIPFEWQHKIPSPYPYRNPVGEDANAIIAASLAALKAKIEELGPERVAAFYAEPIQGSGGVIVPPKGWIKAMRELCREYGILFIADEVITGFGRTGPLFACTDEEIVPDFMTTAKGLTSGYVPMGAVFMADHVYDVIADGAGASSVGHGYTYSAHPVSAAVALEVLKLYEDGLLENGIKAGARLMAGLSGLSDHPLVGDVRGRGMLAAIELVVDKEKKTPLPASAMPARRIFDRAWDNGLIIRAFANGVLGYAPPLCCTDADIDAIIERTRRTLDQTLADPDVRQALA

SEQ ID NO: 10764 - protein, 485 aa, Mesorhizobium loti MAFF303099
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 10765 - protein, 487 aa, Mesorhizobium loti MAFF303099
MGLSFDPDTVSLPVGHFIGGELIAAEGAIEMRRPSDGKAYAASPVADVDMVDRAVASAKAALKASNWGGVRPRERTKALQAWADLIEAEAEALAKIEALCSTRPVGQLVAGDIAITAEQIRFFAEFADKEGSELVPTDDSSLGMIMSEPYGVVGAITPWNFPISMAGWKLGPALAAGNAVVLKPSEMTPFSAVYMAQLALRAGLPAGLVNVVLGDGPTTGTALTGHSEIAKVSFTGSTRAGSAIMENVARTGVKPMTLELGGKSPQIVFADADLDKAATAIAGSVTFNAGQACVAGTRLIAEKSVADRLTATILEKMKAARPGPTWDDATQYSPIISERQRARVDGIVRAAVEAGGECLTGGHTMDGPGYFYEPTLITDVDQANPAIVEEIFGPVLTVQTFETEEEALALSTHPTYGLASGLFTADLSRTIRFARKLEAGTVWVNRYSRSRDHILPTGGYKRSGIGKDLGREAYLANRRSKSVLISL

SEQ ID NO: 10766 - protein, 459 aa, Mesorhizobium loti MAFF303099
MLNQSNELNAWDRDHFFHPSTHMGTHARGESPTRIMAGGEGVTVWDNNGRKSIDAFAGLYCVNVGYGRQKIADAIATQAKNLAYYHAYVGHGTEASITLAKMIIDRAPKGMSRVYFGLSGSDANETNIKLIWYYNNVLGRPEKKKIISRWRGYHGSGVMTGSLTGLDLFHNAFDLPRAPVLHTEAPYYFRRTDRSMSEEQFSQHCADKLEEMILAEGPETIAAFIGEPILGTGGIVPPPAGYWEKIQAVLKKYDVLLVADEVVTGFGRLGTMFGSDHYGIKPDLITIAKGLTSAYAPLSGVIVADRVWQVLVQGSDKLGSLGHGWTYSAHPICVAAGVANLELIDEMDLVTNAGETGAYFRAELAKAVGGHKNVGEVRGDGMLAAVEFVADKDDRVFFDASQKIGPQVATALAASGVIGRAMPQGDILGFAPPLCLTREQADIVVSKTADAVKSVFANL

SEQ ID NO: 10767 - protein, 497 aa, Mesorhizobium loti MAFF303099
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 10768 - protein, 481 aa, Mesorhizobium loti MAFF303099
MDIGLLIDGDKRDASGAAAYERLDPFTGKLATRAAAASVADANAAVEAAAAAFATWSKTGPGERRALLSRAADVMASKVGEFTKLMMEETGATAPWAGFNVMLAANMLREAAAMTTQISGEIIPSDKPGTLAMAIRQPAGVCLGIAPWNAPVILGTRAIAMPIASGNTVVLKASEMCPGTHRLIGQVLVEAGLPKGVINVVTNDPKDAAAIVEALVAHPSVKRVNFTGSTKVGRIIAELAGRHLKPALLELGGKAPLLVLDDAAIDAAVNAATFGAFMHQGQICMSTERLIVDERIADEFVSKLAARASQLPAGDPRGHVVLGSLISSQAADKMEELIADAVAKGAKLVAGGKRTGTVVEATLLDHVTPAMRVYAEESFGPVKPVIRVKDEDEAVRVANDTEYGLSSAVFSRDIKRAMAVAARIEAGICHINGPTVGDEAQMPFGGVKGSGYGRFGGKASIAEFTDLRWVTIEDPGQHYPF

SEQ ID NO: 10769 - protein, 317 aa, Mesorhizobium loti MAFF303099
MKKLVCAGEILVEIMAERIGQSFLAPGPLVGPFPSGAPAIFIDQAARLGQPAGLIAAVGDDDFGHLNIERLRADGADISAIKVHRGAATGTAFVTYETDGSRHFVYNIKHSAAGLIEIGAEARALLAGADHFHVMGTSLFSPEVIEVARKGIETVKARGGTVSFDPNIRKEMLDLPGLRDALHFVLSKTDVFLPSGPELFIFARATDEESAVREMLDRGISAVVIKKGAQGAVHYDKTGRTASPGFVVEEIDPTGAGDCFAAAFVSFWLRGAAPEKALRIANGCGALAVTRKGPMEGIASLAAVEAYVATARTGAPA

SEQ ID NO: 10770 - protein, 321 aa, Mesorhizobium loti MAFF303099
MMEMAMTLDPDALRALVIGRVAGGEPFEKGSVAAARAAYNASFPTQQGEHEPVAASQERQTDGPNGPVKIRVHRGIGAPRAGARAVLYLHGGGWVIGNLSSHDEICRWLANLSNAVVVYPDYRLAPEHKFPAGLEDCTAALRFMAENAGELGIDPARISVAGDSAGGNLAAVLALLARDRLVPRLAAQVLIYPNTDARQTADSYRRFGDGFGLTAATMAWFRDHYVRTPNDITDWRVSPLLASSLAGAAPAFVVIAGHDILADEGTAYAERLRVAGVPLVLRPWPGQIHGFVSMGRHILAARQAVSEAAAWLQLQTRVQAD

SEQ ID NO: 10771 - protein, 316 aa, Mesorhizobium loti MAFF303099
MPAVPSILGFGAIAIDDIVYVDQPLSAGKGRVRQSARAFGGNVATALAAVARLGGSAGFVGWLGTAADDPVLCDLIESGVETAFAPRHADARPVRSRITVGSDGERFIAYDDDAMLGTTPDFSDDILNRAAVLIVDSYAIRSMDVVTRARDLGLAILGDIEWSGGPATERLIGLCDHLILPLGFARTATGCRLPAEMLEALWSPSRSAVVLTDGGRGVYYRGREETRLWQLPPHRVAVVDSTGAGDCFHGAYAHALTRGADTAGRVAFAAAAAALSITGRGGREALPTEDQVTELLASANAPSAVELKYAQLDTGT

SEQ ID NO: 10772 - protein, 240 aa, Mesorhizobium loti MAFF303099
MTSKPLSGPAAIAALPRDRLIAEFSLWSANLANFESDLRRIEPHVDLHHIDVADGHFAPSFLFFPDLVARIAGLTAKPIHVHLMVDAAIVEAQTRQFIEAGADMISVHAENGEAGLRAVRLARELGAEAGVVLRLETPVEAVKPFVSEVAFVTLLGTAIGVKGQSLSDKACDRLGAARAILRGAGREAEVALAADGGIRHETVPLLRAAGAETVVLGSLAFGDKDLAGRIGWLHGLKVAA

SEQ ID NO: 10773 - protein, 451 aa, Mesorhizobium loti MAFF303099
MSDAIADVLSWLESRSDIQSLRAAVCDLNGVMRGKRIPVEQARKALEGKLRMPYSLIGLDIWGEDIEGNSLVFSTGDADGLCQWTGRGILPVDWTAHPTALVPLWLADESGAPYLGDPRRALARILDRYKALGLTPVAATELEFYLVDPQSQRPVGPVSPVTGRRLDSDAALSIDEIDDFEAFIHDVYEACRAQGIPVDTAIAENGVGQFEINLNHVADALRAADDAVLFKRTVKGIARKHGFAACFMAKPYGDRAGNGFHVHFSLVDAEGRNVFDDGTDQGSQTMRHAVGGLLAAMAESTLVFAPHFNSYRRLRPRSYAPTAVAWGYENRMVAIRIPGGPAGARRIEHRVSGADANPYLVLAAILGAALIGIERQMSPGEPTGSDGQGAVPAKLPPDWASAIATFESGTHVAEIFPAILRDSFVACKRQELNTFALNVSDFEIETYLESV

SEQ ID NO: 10774 - protein, 254 aa, Mesorhizobium loti MAFF303099
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 10775 - protein, 452 aa, Mesorhizobium loti MAFF303099
MKTRVAVIGAGPSGLAQLRAFKSAADKGADIPEIVCFEKQSDWGGLWNYTWRTGLDEHGDPVHGSMYRYLWSNGPKECLEFADYTFEEHFGRPIGSYPPRAVLWDYIKGRVEKSGLRKWVRFNSPVRMVTFSDETKKFTVTAHDRTNDVTYSEEFDNVVVASGHFSVPNVPYFEGFATFNGRILHSHDFRDAMEFKGKDILIIGRSYSAEDIGSQCYKYGAKSITSSYRSKPMGFKWPDNWKEVPLLQKVVGKTAHFKDGTSKDVDAIILCTGYLHSFPFLTDDLKLKTANRMWPLDLYEGVVWEKNPKLSYIGMQDQFYTFNMFDAQAWFARDVIMGRIKLPSAKAMAEHSAKWRAREETLEDAEQMIWFQGDYTKELMDQTDYPGFDVEAVNQTFMEWEHHKAEDIMGFRDHAYRSLMTGTMAPLHHTPWLQALDDSMESYLEVKGVAAE

SEQ ID NO: 10776 - protein, 309 aa, Mesorhizobium loti MAFF303099
MRDPYEVLGVAKNASAKDIKSAYRKLAKKHHPDQNPNDPKAKDRFAAANQAYEIVGDEKNRAAFDRGEIDADGKPRFQGFEGAAGGGDPFAGFRRQQGAGGSRFEFRSGRPGGDPFDGNSDIFSQIFGDAFSGARGAGMGDRRQPATAADLNVTLDVTIEEAATAEKVTAMFPDGRKVAVKLPAFVEDGQTIRLKGQGEQGPGQPGDALVKIHIRRHPRYRIEGRDLHADVPVSLADAVLGAKVPVETPTGRLAVNVPAWSSSDKVLRLKGRGLPEKAGGHGDLYAHVRIMLPEGGDSALEALLRGQKG

SEQ ID NO: 10777 - protein, 308 aa, Mesorhizobium loti MAFF303099
MTTRLYTHPIFLEHITPPGHPERPDRLRAIERVLDDEAFAALDRVKAPEGDEATILYAHPADFVARVRAAIPEEGIARIDADTTASPKSWQAVIAAIGAANAAVDDVFAGRADNVFVAARPPGHHAEKTTAMGFCFFNTAAIAARYAQNKHGAERVAVVDWDVHHGNGTQDIFWDDPSVLYCSTHQMPLYPGTGAKTETGAGNIVNAPLAPQTGSEVFRDAFLSRVLPSLDNFAPDLIIISAGFDAHHRDPLAEINLTEDDFDWATGQLMQRAARHSGNRLVSLLEGGYDLQGLAFSVAAHVGRLMKG

SEQ ID NO: 10778 - protein, 307 aa, Mesorhizobium loti MAFF303099
MILCCGEALIDMLPRITTQGEPAFAPYVGGAVFNTAIALGRLGAPAGFFSGLSSDLFGGQFRDALGASKVSSTYAHTSPRPTTLAFVRLTNGQATYTFYDENTAGRMLTIDDLPSLGNEIEAMLFGAISLISEPAGGAYEEFMRREHASRVMMLDPNIRPNFIPDKAKHLRRIREMMAMADIVKLSDEDLHWFGEAGSHEDVIRNWLDRGPKLIVVTHGSEGAVGYTKDHTVTVMPEKVEVVDTVGAGDTFNAGILASLHEQGLLTKAAIGGLPQDAIRKALALGAKAAAVTVSRAGANPPWRHEIA

SEQ ID NO: 10779 - protein, 487 aa, Mesorhizobium loti MAFF303099
MRAQPTASHYVNGRYIDDEQGAPLPVIYPATGETIAMLRSATPNVLELAIEAARAAQPAWARLKPVERGRILRRAADILRARNADLARIETLDTGKAIQETLVADAPSAADCLEYFGGAVAAYNGEAVDLGGPFAYTRREALGVCVGIGAWNYPIQIAGWKSAPALAMGNAMVFKPSENTPLSALALAEIYSEAGLPDGLFNVVQGYGDVGAGLVGHDVVAKVSVTGSVPTGRKVLSLAGSKMKHATMELGGKSPLIVFDDADIENAIGGAMLGNFYSTGQICSNGTRVFVQSGIHDRFVERLVERTKKIRIGNPLDPETQMGPLVSKAQHEKVVGYIGIGKQDGAVLACGGNVPSLQGFDGGFFVEPTVFTGVTDTMRIAREEIFGPVMSVLKFDGEDEVIDRANDTEFGLAAGVFTRDLPRAHRVIAELQAGTCWINAYNLTPVEIPFGGFKQSGIGRENSLAALALYSQLKSIYVETGDVASPY

SEQ ID NO: 10780 - protein, 364 aa, Mesorhizobium loti MAFF303099
MQQPGRAAEIKAIGIGKSFGSFRALDNLSLNIGRGEFLTLLGPSGSGKTTFLMILAGFVQPTEGKLFSDGTDITDRPAEQRAAGMVFQGYALFPHMSVEANIAFPLKVRKKSAADIKKRVGEMIERVGLIGHEKKLPSQLSGGQQQRVALARALVFEPGVLLLDEPFSALDKSLRGQMQAEMKRLHQETGTTFVFVTHDQSEALALSSRVAIFNHGKLLQVGAPDEVYDRPDNRFVAEFLGEINMLPLKGVKPADNGSTGLCEDRAVNMHCKAEKVRGDAILAIRPEHMSIAREAAAGENGIAATAIASTYLGAATKLDLTTRQGAKVTVSVPNEVAAAALSKGNSVWLTWPAEKGFLLPDGGQ

SEQ ID NO: 10781 - protein, 467 aa, Mesorhizobium loti MAFF303099
MAKSRVQFICQNCGSVHQRWAGKCDACGEWNTLVEEGTSGGIGSGPANMRNARKGRAVVLTTLSGDIEDAPRIISGIGELDRATGGGFVRGSALLVGGDPGIGKSTLLTQAAAALASRGHRIVYVSGEEAVAQIRLRAQRLGVADSPVELAAETNVEDILATIADGKRPDLVILDSIQTLWTDLADSAPGTVTQVRAAAQAMIRYAKSTGAAIVLVGHVTKEGQIAGPRVVEHMVDGVLYFEGEGGHHYRILRTVKNRFGPTDEIGVFEMSDKGLREVSNPSELFLGERHAKSPGAAVFAGMEGTRPVLVEIQALVAQSSLGTPRRAVVGWDGARLSMVLAVLEAHCGVRFGQHDVYLNVAGGYRISEPAADLAVAAALVSSLTGLALPADCVYFGEISLSGAVRPVAHAQQRLKEAEKLGFGSAVLPLGSEELAGGIGAGAFQPTELADLVARIAGSRRSRVDEEE

SEQ ID NO: 10782 - protein, 267 aa, Mesorhizobium loti MAFF303099
MATENAVSAEEIKVNAAKMHISTTDVAIDIIAMHKWYGEFHVLKDINLKVMRGERIVICGPSGSGKSTMIRCINRLEEHQKGKIIVDGKELTNDLKKIDEVRREVGMVFQHFNLFPHLTILENCTLAPIWVRKTPKKQAEEIAMHFLKRVKIPEQANKYPGQLSGGQQQRVAIARSLCMNPRIMLFDEPTSALDPEMIKEVLETMVGLAEEGMTMLCVTHEMGFARKVANRVIFMDQGQIVEQNTPAEFFDHPRHERTKLFLSQILH

SEQ ID NO: 10783 - protein, 436 aa, Mesorhizobium loti MAFF303099
MSAMSNIWSNWSGFVTAEPRLIASPADAGELGDLVRTAPGPVRVVGAGHSFTPLVKSQGTILSLEKLEGLVSHDPQKHQARVKAGTRLGPLMHILQGIGQGLPNMGDIDRQAIGGALGTATHGSGPTLGAYHTQLETVQIVDGLGKVRDFTRAGDQDMIHAIGVALGAFGVLSEVTLNNIATYRLRRRKWVLPIGDMLRDFEKMMTAHRSAEFYYIPFSGYAQFIASDFSTEATTTRPTDDDEGSLRTLRRLRTGLAWLPSLRRRLILGAVAKVPSEDYVQDWLNVYASDRQTKFNEMEYHLPFEEGPKALAEIIELTEKRFPEVYFPMEVRSVAPDKFWLSPFYNRPTCSIAIHHDAASDPLPFMQAAEPIFRRYGGRPHWGKMHSLKAADFKKLYPRWDDAMAVRRDIDPQNRFVSPYMAGLFGIEPSPFGIDP

SEQ ID NO: 10784 - protein, 500 aa, Mesorhizobium loti MAFF303099
MAKIIETSTGALALTFDDVLLQPGHSEVMPGETDVRTRIAGDIDLNVPILSAAMDTVTEARLAIAMAQAGGIGVIHRNFSPAEQAEQVRQVKKFESGMVVNPVTIGPDATLADALSLMRTYSISGIPVVENGGTGGHKTGRLVGILTNRDVRFASDPAQKVYELMTRENLITVKENVDQDEAKRLLHQHRIEKLVVVDKQGNCVGLITVKDIEKSQLNPHATKDAQGRLRAAAATSVGDDGFERAERLIDAGVDLLVIDTAHGHSQRVLDAVTRAKKLSNSVRILAGNVATAEGTQALIDAGADAVKVGIGPGSICTTRIVAGVGVPQLSAIMSAVETAHKSGVSVIADGGIKYSGDLAKALAAGASAAMIGSLLAGTDESPGEVYLHQGRSFKAYRGMGSVGAMARGSADRYFQAEVRDTLKLVPEGIEGQVPYKGPVSGVLHQLAGGLKAAMGYVGGRDLADFRERATFVRISNAGLRESHAHDVTITRESPNYPGGA

SEQ ID NO: 10785 - protein, 481 aa, Mesorhizobium loti MAFF303099
MALACCGATKRSGAEGRGTMDYDMLVIGSGPSGRRAAVQSAKLGKSVLVVDRGRRLGGVSVHTGTIPSKTLRETVLNLSGWRERGFYGRGYRVKQDISVGDLIERLHKTLDHEVEVLQHQFMRNTVKSARAAVKFLGPNKVSLTSDNGDYSEVGFANALIAVGTRPHRPRDVPFDKTRIFDSDEMLEIDRLPRTLTVIGGGVIGVEYATIFSALDVPVTLVEPRNSILDFVDREIVDDFIHQMRDRGMTIRLGSAVKEIRSKPEAAEVELADGRTIRSEVVLYAAGRTGNVGSLGLDVVGIDADSRGRIKVDPQTFQTNVPNIYAAGDVIGFPSLASTSMEQGRVAACHAFGVTLPPPPETFPYGIYAVPEISTVGQSEEQVRESGAAYEVGVARFRETSRGHIMGVNTGFLKLLFSIETRRLLGAHIVGEGATELIHIGQAVINLGGTVDFFVNNTFNYPTLAEAYKIAGLDAWNRMGRG

SEQ ID NO: 10786 - protein, 335 aa, Mesorhizobium loti MAFF303099
MATKNIDHAFTARSKTGGALEPTYSGALSFMRRKYTKDVKGADAVVWGIPFDAAVTNRPGARFGPQAIRRASAILDNDPQYPFSRDLFEHLAVVDYGDCLLDSGNHQKTPGTIEREAAKILKSGAFLLTLGGDHFVTWPLLKAHAAIHGPLALVQFDAHQDTWEDDGKRIDHGSFVGRAVKEGIIDPDRSIQIGIRTHAPDTFGIKILYGHEIEEMRASDIAYAIVDRTGGKKTYLTFDIDCLDPAYAPGTGTPVAGGPSSAKILSTLRQLNQVDIVGADVVEVAPAYDHADITAIAGSMVAMQYLGLLAERKARQEEMNNGNHNGAAVNHGNGI

SEQ ID NO: 10787 - protein, 287 aa, Pyrus communis
MAKDMEVAERGSFSAKDYHDPPPAPLIDAAELTKWSFYRALIAEFVATLLFLYVTVLTVIGYKSQTDPAVNADACGGVGILGIAWAFGGMIFVLVYCTAGISGGHINPAVTFGLFLARKVSLVRAVLYMVAQSLGAIAGVALVKAFQKSYYIKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 10788 - protein, 1360 aa, Streptomyces verticillus
SARGEPSGAVTGRPVSGEPSGTLTGQSVPGEPSGTATDGPVPGEPSVTATGQLASGEPPMTATDIASAAASQVAALRADWRGHDYPRFVAALKMAASHCYAAALAAFLPRPDAPFTAADLLRVGTVPRHATFLSAVLPELRRHRLVGRDDSGGYRLLRTRFDDTKALRDLILRFPRYAPEGRLALHGLRVLRAAGDHRPVEHLLSDGGLADLEQLYDTGVIGRFHNRLAQALLRVVVERWPDDRPLRVLEVGAGTGGTTAALLPLLPPERTRYVFTDVSPAFLTRAEHRFAAYDFLTFRTLDLDADPAAQGLPEGGFDVVVAANALHTARSVEAAVRNVAALAAPNGLLLAVESHDPYVLAPLFGALDTFWDRTDHHERPHSPLLTADRWAALFTRCGFTDVVRTGDDTAPCRDDFSVLLATAPRRPTPHPYPYPHPSPPGPGRHWTVVAETRGELPLAREVAARLPGPGDGPAHSVEAVDDVPAHRPSTPSRGATGICLILGAHQLPEPAATVTLTTRRAALLRRITAACPRRPDGARTALTVVTRPSGALPPPERPLAPEDAAVWGVMRTLANEEPELDVRTISLDRTGRTETDARRLARELLTATGETEVALTRSGGRFAPRELPLPAGHITTTAEHATAYALEIRTPGLSYRPAWVECAPEPVGPGEVAIDVRAAALNYRDIMQAVGLLPAEADEGTFTEAGPGLECAGVVTAVGDGVTTVRPGDRVFALAPASLASRTRTVVQAVGRMPHTMSFAEAATLPVVYATVHYSLHDLARLRPGETVLVHGGAGGVGLAALRYAHLRGARVIATAGTPAKRELLRHLGADHVLDSRGLDFAAHVRDVTDGRGVDVVVNSLAGEAITRGLELLRPGGRFVELGKRDIYENQPLLLRPFRHNLAFFGVDLTSLAFDPDQGARLFAEVTRRVHDGSYRPLPHSAYPAARVAEAFRLLQHSRHVGKVVVTFDPLDEPAVVERPVTAPRFGSQGTYLVTGGTSGFGAAGARWLADRGVRRLALVSRRGPHAPEAAGLLADLAARGVTATAYAADAADPDGMRRVIRLIDATGHPVDGVLHCAMHLDDDPLADLTDERFAAVLTPKTTGAAVLERLLADRPLETFLLYSSDTTFLGNIRQAAYVAANLHLEALARQRRQRGLPAQTLAWGAIDETGYVARNDLARTLTAVGIEPLSPREALTTAGLLISQGATVAGVGRYNWARLRGVLPLLASPRCASLLPEDLQEADHTHEEILRILATMPYEEAARAVAATLARLMADVLHLDERNIDHDRRLDEYGLDSLMLAELLVSLRKRFDIDIPPLELLRSGGTITDISHLVLLRLGITADDPEPPARDAEQSVGER

SEQ ID NO: 10789 - protein, 425 aa, Mesorhizobium loti MAFF303099
MSGRSLMSPVWHPFTQHALELAIPEIARTEGAYLHKADGTRILDAISSWWVVTHCHRHPRIIKAIETTAASLDQIIFAGFTHEPAERLARALVGLAPAGLDWVFYSDSGSTSVEVALKMALGYFRNIGAPRSRIVVMEHSYHGDTIGTMSVGARGVFNAAYEPLLFEVDTIPFPAAGQEQETLDRFEAVSRDRRAAALIVEPLVLGAGGMQMYPAWVLAELKKITEASGTLLITDEVMTGWGRTGTMFACEQASISPDILCTSKGLTGGTIPLAATLATDAIFQAHYSEDRKKTFFHSSSYTANPIACGAALANVEIWRDEPVAERIAALSAMQAAGLRRFGDNPRFTDSRVTGTIAALDLRTSSAGYLADIGPKLRAFFLERGLLVRPLGNVLDLMPPYCITGDELDGLYDAIEEAAERFGSRP

SEQ ID NO: 10790 - protein, 419 aa, Mesorhizobium loti MAFF303099
MGDFVIIGSGVAGHRAAAELHRLDPSQSVYVVGTEPGAPYDRPPLSKEYLKTTEPVRPDLGPAEIYKSNVTLRDGLTATSIDRPNQTIALSDGSSIQYDRLLLATGSRLRHLDLPNIDPARVFYLRTILDAQRLRTALDNHLRIAIIGGGFVGLEIAAAAKRNGCTVTLLERAPELLSRGATPPLAEFARKMHSRQDVRIFLGINISEAFQDGSDIVLRWPEGEVRSDILVVGVGIIPNIELALQCGLATADGILVDQQCRTSDEWIFAAGEVTSYPVDRLGVHIRTESWSSASAQGTVAATSMLGRNGMFNELPWFWSDQYDCNIQCLGLPKRASRFHQIGDLNSESWLRIGVDDAGSLVGAESVNKGREMSALRRADRRGEPIPTALIKDSILVQSCSTVGDLGAGSASLNVNVRTQ

SEQ ID NO: 10791 - protein, 351 aa, Mesorhizobium loti MAFF303099
MDAVRKRLPYAGYSEAYALPSIIKCETNLYLAQFAFMKLLPAKYIIEQALAQGTLTHGMKVLETSSGTFALGLAVVCRERGFQLEIFTDPVMDRGLENRLTSLGAEVCIITEKAREGGYQRSRLDALHARMRQLGHSCFWPRQYETPDNPAAYKLFADQISGMLDADVTLVGSVGSGGSTCGTIERLRQKAPGARLIGVDTFNSVIFGQQDGERKLRGLGNSLVPKNVKHELYDEVHLISAPLAFAATRTLHERHAVFAGPTSGASYIVGRWRARQYPGETVVVICPDEGHRYVETAYDHEWLRQNGCLHEGALQDTPSSEEHPSTALPPWNRYLWRRKSREAVLSLLEEV

SEQ ID NO: 10792 - protein, 359 aa, Mesorhizobium loti MAFF303099
MEQNPVLEIRNLSRTFAHGAVRAVDHIDLDVLPGEIMSILGPSGCGKTTIMRIIAGLDSPTSGEVRILGKDVAGKPPHKRNVGLVFQSLAIFPHMSVKQNVAFGLRMKGLASNLIETKVAKALELVQLSPERFAGRRPSELSGGQLQRVALARTLVTEPALVLFDEPMAALDRRLRDYMAVELRAIQKQLGIAAVYVTHDQETASMMSDRVIIMSAGKILQAGTPEEIYEAPNSRFVSDFLGDTNTLRIARVLHQADGTSLVQTDAGLAIRVANCSDIAEGAFVIFRPEQTIVHSADPGGAFEGRVVSSQFRSGLHRWQIALPGGNTLIAQSTENRLASSAGETAWVTIDSGKARIVSQ

SEQ ID NO: 10793 - protein, 357 aa, Mesorhizobium loti MAFF303099
MVSPAVDHFKDLETPRLALLAPNLVAAAFPLMKLMPARYILDRAASNGELKTGSHIVETTSGTFGMAVALLAAARDYRLTLVTASTLIDAKYRARLERIGATVIALDDPRGDGNQPGRLERLQEILAKEPDGFWTRQYDSPGNWLAYARLAELLIRAIGKVDCLVGCVGTGGSLCGTASFLRTVFPHLTVFAVDTHRSILFGQPVGRRMLRGLGNSVLPKNVRHELVDEIHWVGAYPAYMTAHRLLREHGLFMGPTSGAAALVAQWVATTLPDAQVAVIMPDEGHRHAETVYNDEWLSALPGWPCKELSEPRTLTTIAPAAETQWTRFLWLRRSLGDVLKTQAAGEVPPAVGAAENL

SEQ ID NO: 10794 - protein, 349 aa, Agrobacterium tumefaciens
MVPIWRRKMETAMLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 10795 - protein, 359 aa, Fragaria x ananassa
MSIEQEHPNKASGWAARDSSGVLSPFNFSRRETGEKDVMFKVLYCGICHSDHHMVKNEWGFSTYPLVPGHEIVGEVTEVGSKVQKFKVGDRVGVGCIVGSCRSCENCTDHLENYCPKQILTYGANYYDGTTTYGGCSDIMVAHEHFVVRIPDNLPLDGAAPLLCAGITTYSPLRYFGLDKPGMHVGVVGLGGLGHVAVKFAKAMGVKVTVISTSPKKEEEALKHLGADSFLVSRDQDHMQAAIGTMDGIIDTVSAQHPLLPLIGLLKSHGKLVMVGAPEKPLELPVFPLLMGRKMVAGSGIGGMMETQEMIDFAAKHNITADIEVIPIDYLNTAMERLVKADVRYRFVIDIGNTLKASS

SEQ ID NO: 10796 - protein, 242 aa, Mycoplasma flocculare
MKKIIIGNWKMNKTVHETRDFIQKFDIFYSKNLGKIKDNLDFAIAPSFTSLALISTSKIDKLKVAAQNLSQFDSGAFTGEISAKMLQDLAVHYVIIGHSERREIFKEIGEDLTNKILQAQKYNLIPVFCVGESLSEFEANETEKVIIGQINEVKSVLNFEKAIIAYEPIWAIGTGKTATAQIAEQVCKLIKNNFGKNIRVIYGGSVNSKNINELLLQKNIDGALVGKASLDPEEFVKILANI

SEQ ID NO: 10797 - protein, 501 aa, Asparagus officinalis
MTVSITAAVQLFLLLLLLLPLLFVHHKTKPKTKCRSPPGPPPLPVIGNLHQLSLLLHQSLYRLSKIHGPIFKLSLGRVPVLVISSPSLAKQVLKTHDLACCSRASTVSFKEYTYDGCDVAGAPYGDSWRNLRKIFVLKLLSSKKLTSFRLVQEEEIEGMISSIRTRSDTNATVNITEFVVRLANNITFRVAFGYRSEGEYGEKSRFQRLLESGNDTVASFYVGDYFPGLGWLDKMTGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 10798 - protein, 501 aa, Asparagus officinalis
MTVSITAAVQLFLLLLLLLQLLFVHHKTKPKTKCRSPPGPPPLPVIGNLHQLSLLLHQSLYRLSKIHGPIFKLSLGRVPVLVISSPSLAKQVLKTHDLAFCSRASTVSFKEYTYDGCDVAGAPYGDSWRNLRKIFVLNLLSSKKLTSFRLVQEEEIEGMISSIRTRSDTNATVNITEFVVRLANNITFRVAFGYRSEGEYGEKSRFQRLLESGNDTVASFYVGDYFPGLGWLDKITGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 10799 - protein, 444 aa, Arthrobacter sp. FHP1
MDLLNEVRKAPMSRLQIRAVAVAIALMLIDGMDVAVAAYAAPALSKSWGLDPVTLGFLLSSGLFGMAAGSLFLTPFSDKIGRRRMMLVALILVSVGMTLSVFAGDVVQLMVYRVLAGLGIGGMIANLNVFVSEYSSDKRRGSILGLYTSGFAIGATLGGFIAGPLIPQFGWRSVFVVGAAASILMLAVTWRFLPESLDYLISKRPRNALTQVNAILVQMHRPALSALPELPQDQQIGRGIKDLLTGRMAAQTVLLWVGYGLMISAYYFATTWTPKLIASSSGDDSLGVTMGLLVNFGGIIGCFIFSILAVFLRSRHLLLGSLLISALIYVLFGMTFTQTSLAIFIGAVLGLVTAANVAGFYATTPDLFPPAIRGTGIGWMIGIGRLVSFVSPIVVGYLLAGGWKAANIFMLFGLPLVVSALSMAVVWSLSTKTKPSTPVPTIIS

SEQ ID NO: 10800 - protein, 371 aa, Francisella tularensis
MQQKCYYEILNISKTASGVEIKRAYRKLAMKYHPDRNPGDKEAEIKFKEISEAYEILSDDSKRSRYDQFGHAGVNQQSGFGGTGGFEDIFDTFFGGGTSRGSNRSRASRGSDLEYTLEITLEEAFFGVEKEITIPRMESCDSCDGTGSKSRSKTTCHACHGQGTIRRQQGFFAFEQTCPVCNGTGYSITDPCDACYGNGKVKKQKTLKVKIPEGVDNGDRIRLQGEGDSGSNGAMNGDLYVQIIIKEHKIFERRDINLYCEMPISFTKACLGGDIKVPTLDGEVVLKVVPETQTGKVFRLREKGMKSLRGHRRGDLLCKVVVETPVNLSAEQKELLEKFADSLGEDYQSKHAPKSKTWFDNVKDYAKKFFE

SEQ ID NO: 10801 - protein, 475 aa, Coleochaete orbicularis
MSPLTETKAGTGFKAGVKDYRLTYYTPEYETKDTDILAAFRMTPQPGVPPEEAGAAVAAESSTGTWTTVWTDGLTSLDRYKGRCYDIEPVAGEDNQYIAYVAYPLDLFEEVSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIFKSQAETGEIKGHYLNATAGTSEEMMKRAQFARELGVPIIMHDYLTGGFTSNTSLSHYCRDNGLLLHIHRAMHAVIDRQKNHGIHFRVLAKALRMSGGDHIHSGTVVGKLEGEREVTLGFVDLLRDDYIEKDRSRGIYFTQDWVSMPGVLPVASGGIHVWHMPALTEIFGDDSVLQFGGGTLGHPWGNAPGAVANRVALEACVQARNEGRDLARQGNDIIREACKWSPELAAACEVWKEIKFEFETIDTL

SEQ ID NO: 10802 - protein, 475 aa, Equisetum arvense
MSPQTETKAGVGFKAGVKDYRLTYFTPDYETKDTDILAAFRMTPQPGVPPEEAGAAVAAESSTGTWTTVWTDGLTSLDRYKGRCYNIEPVAGEDNQFIAYVAYPLDLFEEGSVTNLFTSIVGNVFGFKALRALRLEDLRIPPAYSKTFIGPPHGIQVERDKLNKYGRPLLGCTIKPKLGLSAKNYGRAVYECLRGGLDFTKDDENVNSQPFMRWRDRFLFVAEALFKSQAETGEIKGHYLNATAGTCEEMLKRAVFARELGAPIVMHDYLTGGFTANTSLAFYCRDNGLLLHIHRAMHAVIDRQKNHGIHFRVLAKALRMSGGDHIHTGTVVGKLEGERDLTLGFVDLLRDDFIEKDRSRGIYFTQDWVSMPGVLPVASGGIHVWHMPALTEIFGDDSVLQFGGGTLGHPWGNAPGAVANRVAVEACVQARNEGRDLATEGNDIIREAAKWSPELAAACEVWKEIKFEYEAMDTL

SEQ ID NO: 10803 - protein, 477 aa, Lactuca sativa
MSPQTETKASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLDDLRLPAAYVNTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWKNAPGAVANRVALEACVQARNEGRDLATEGNEIIREATKWSPELAAACEVWKEIKFEFQAMDTLDQ

SEQ ID NO: 10804 - protein, 475 aa, Spirogyra maxima
MSPQTETKAGAGFKAGVKDYRLTYYTPEYETKETDILAAFRMTPQPGVPPEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFQGPPHGYQVERDKINKYGRPLLGCTIKPKLGLSAKNYGRAVYECLRGGLDFTKDDENVNSQPFMRWRDRFLFVAEAIYKAQAETGEIKGHYLNATAGTCEEMMKRAEYAKELGVPIIMHDYLTGGFTANTSLAHYCRDNGLLLHIHRAMQAVIDRQKNHGIHFRVLAKALRMSGGDHIHSGTVVGKLEGERQVTLGFVDLLRDDYIEKDRSRGIYFTQDWVSMPGVLPVASGGIHVWHMPALTEIFGDDSVLQFGGGTLGHPWGNAPGRVANRVALEACVQARNEGRDLAREGNEVIREACKWSPELAAACEVWKEIKFEFDTIDTL

SEQ ID NO: 10805 - protein, 377 aa, Lilium hybrid division I
MENVKGPVVVTGASGYVGSWLVMKLLQYGYTVRATVRDPRDLRKTKPLLDLPGADERLTIWKADLSEDGSFDEAINGCTGVFHVATPMDFDSEDPENEVIKPTINGVIGIMKSCKKAGTVKRIIFTSSAGTVNVHEHQMPEYDESSWSDIDFIRRVKMTGWMYFVSKILAEKAAWDFAKENDIQFISIIPTLVVGPFITTTMPPSMLTALSLITGNEAHYSILKQIQLVHLDDVCNAHIFLFENPEAIGRYICSSYDTTIYDLARKIKDRYPQYAIPQKFEGIDDQIKPVHFSSKKLIDLGFKYQYTFEEMFDEGIRSCIEKNLIPRQTQERYYADDKLNLCCTKMTNDKLDLGGMKLNSLDEIVRGHNEQVSVALQ

SEQ ID NO: 10806 - protein, 418 aa, Solanum tuberosum subsp. andigena
MVRNRREELYVTVPSLFRCPISMDVMKSPVSLCTGVTYDRSSIQTWLSQGHNTCPATMQILPSTDFIPNLTLRRLINVWIQHQPSSSPGYTTPSSSSVTKSEVVEIVKNLNGEVDRLSSLAKIVEFVKCSGENRRFFVNSSDAIVSVVGVLVDCDVGEVCEAVVAVLDLVVSENGVKEQLNKEILKSDRKFLPKFLLILRKGKLSSRIQTARILEFIALDADSQRKMIEEQGLLYELHVFTSTETNRFAIEAGLSTLIAVSTTRPAKKELVRFGIVQTIGKILSGSETARAVVEKSLKLLETVATCTEGRAAIVKGEECMSAIVTRLMKSSKAATEHGVTVLWSVCCLFRDTAARDVVGKANGLTKVLLVMQSDCSAAVRQMCGELVKALRVVNNKHKNYSKSCLASYDTKTTHIMPY

SEQ ID NO: 10807 - protein, 469 aa, Itea japonica
  misc_feature (465)..(465): Xaa can be any naturally occurring amino acid
TKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEXMDTL

SEQ ID NO: 10808 - protein, 469 aa, Menispermum canadense
TKASVGFKAGVKDYKLTYYTPEYVTKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKGLRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMLKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEVIREASKWSPELAAACEVWKEIKFEFEAMDTL

SEQ ID NO: 10809 - protein, 471 aa, Caulophyllum robustum
  misc_feature (381)..(381): Xaa can be any naturally occurring amino acid
TKASVGFKAGVKDYKLTYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKGLRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALNKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGERDITLGFVDLLRDDVIEKDRSRGIYFAQDWVSLPGVLPVASGGIHVWHXPALTEIFGDDSVLQFGGGTLGHPWGNAPGAVANRVALEACVQARNEGRDLAREGNEIIREACKWSPELAAACEVWKEIKFEFEAVDTLDK

SEQ ID NO: 10810 - protein, 471 aa, Caulophyllum thalictroides
  misc_feature (3)..(3): Xaa can be any naturally occurring amino acid
  misc_feature (15)..(15): Xaa can be any naturally occurring amino acid
  misc_feature (32)..(32): Xaa can be any naturally occurring amino acid
TKXSVGFKEGVKDYXLTYYTPDYVTKDTDILXAFRVTPQPGVPPEEAGAAVAAESSTGTWTTVWTDGLTSLDRYKGRCYHIEPVAGEDNQYICYVAYPLDLFEEGSVTNMFTSIVGNVFGFKGLRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALNKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGERDITLGFVDLLRDDVIEKDRSRGIYFAQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTLDK

SEQ ID NO: 10811 - protein, 469 aa, Decumaria sinensis
  misc_feature (267)..(267): Xaa can be any naturally occurring amino acid
TKASVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGXFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 10812 - protein, 469 aa, Decumaria barbara
  misc_feature (117)..(117): Xaa can be any naturally occurring amino acid
TKASVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGXVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 10813 - protein, 408 aa, Chondrostereum purpureum
MTSFSSLFKLLILVSVTAAAPSKRATCTVKSVDDAKDIAGCSAVTLNAFTVPAGKTLVLNPDKGATVTMAGDITFAKTTLDGPLVTIDGTSINFVGADHKFDGNGALYWDGLGTNNGTHKPHPFLKIKGSGTYKKFEVLNSPAQAISVGPTDAHLTFDGITVDDFAGDTKNLGHNTDGFDVSANDVTIQNCIVKNQDDCIAINDGKNIRFENNQCSGGHGISIGSIATGKHVSNVVIKGNTVTRSMYGIRIKAQRKATSASVSGVTYDGNTISGIAKYGLLISQSYPDDVGTPGTGAPFSDVNFTGGATTIKVNTAAKRVTVECGNCSGNWDWSKLTVTGGKAGTIKSDKAKITGGTYLEDDMDQPDGGETEPEEMPAQDPNDPEDPDTAMQEAEAEEAAAGDPTPSD

SEQ ID NO: 10814 - protein, 403 aa, Pseudomonas putida
MTDQWDAGRLDSDLEGVGFDTLAVRAGQNRTPEGEHSEALFLTSSYVFRTAADAAARFAGETPGNVYSRYTNPSVRAFEERLAAMEGAEQAVGTSTGMAAILAVVMSLCSAGDHVLVSQSVFGSTISLFEKYFKRFGVEVDYVPLVDLTGWEKAIKANTKLLIVESPSNPLAELVDITALSEIAHAQGAMLVVDNCFSTPALQQPLKLGADIVFHSATKFIDGQGRCMGGVVAGRTEQMKEVVGFLRTAGPTLSPFNAWIFTKGLETLRLRMRAHCESAQALAEWLEQQDGVEKVHYAGLPSHPQHELAKRQMSGFGAVVSFEVKGGKEGAWRFIDATRVISITTNLGDSKTTIAHPATTSHGRLSPQEREAAGIRDSLIRVAVGLEDVADLQADLARGLAAL

SEQ ID NO: 10815 - protein, 489 aa, Thermoplasma volcanium GSS1
MNFLISVYNKEGLTDFLARVKANIDYIYATGGTAKFLEKNGYTVRDTSEITGFSDLLGGRVKTLHPKIYAALLYREKNEASDLHFDVLVSNLYPFTGNTGNENEMIENIDIGGVSLTRAAAKNYKNVLVLSSPDDYTEAAEIISSGKNDAEYRKRMALKAFARMAEYDAIIYNGLSDLFKIEKENFFVVGKKGERLRYGENPDQEGFLYSDGSAYGVANAEKLNGKELSYNNILDADSAFDTALEFDEPTVVVMKHNTPSGVSSHNDIVNAFKRAWDADSESAYGSVIAVNRKVPLDLAKEMRHLFIEVLIAPEYDEYALSELRKKKNLRILRIPWIRDQSMRYRSISNGLLVQTPMASSFKELKLVTEKGADSKTIDDLLFAWKVVAHSRSNAIVFAKDKTTTGIGAGQTSRVESVRIAMERSGSRADGSVMASDAFFPFPDSIDVAAKAGIKAIIQPGGSIRDEEVIKKCNEYGIPMYFTGKRVFLH

SEQ ID NO: 10816 - protein, 449 aa, Thermoplasma volcanium GSS1
MMQEELNGIKIKVTPPGPEAKKIIELNDKYLARSTQSLPVVGKLGKGVYVEDVDGNVYLDFASGISVTNLGHLDPYVTQKVEEQLHKLWHFPGTDFYTEMQVLAAKSLIEVTPGKFNKKVFFTNSGTESVEAAIKIAKSYTHRERFIGFIGAFHGRTQGSLSFTASKPIHHKGFFPSMPGVEHVPFPNPYRNPFNIDGYEEPDELVNRVIDYIETYLLKTYVPPEDVAGILAEPIQGEGGYIVPPMNFFKELRKLADKYHIPLLIDEVQSGFGRTGKFFASEHFGVEPDVITLAKSIASGIPMGAAVMKEEMNFSENGLHSNTFGGNLIASAACVATIDEMKKLNAVENAAKQGAYMKKRLVELQNKYNEIGDVRGLGLMLAIDFVKDRRTKEPNSKLRNDVINNAFKNGLILLSTGSSAIRIIPPLIITQEQVDEGIEVLDKAIKMSK

SEQ ID NO: 10817 - protein, 436 aa, Thermoplasma volcanium GSS1
MYDAVVLGAGPGGYAAAIRLGQRKKKVAIIEKDKIGGECLNYGCIPSKAIIELANSINYLKEMPGVSINYNVDMKKWQEWKWSMINKLTGGVELLLKAYGVDIFRGTGYIQDKNHVKVNDKVLETDSLVIATGSKPVSINGINDVMYNREVLDLDHIPSSIVIIGGGYIGVEIGIALAKLGSKVTIVEMMPSILPGTDNELVRHVVRRMSQLGINVITGRKVLSTAKNGEVTVKLDDGQELRAEKVLMTVGRIPNTEGFGLENLKLAMDGRFIKTDSRKMTSVKGVYAIGDVSGQPMLAHKAYYEADIAADNICGIDSEVDYRAMPYVIYSDPEIAYTGVKGAKSTRFPVAANGRSLTMNENIGTFNIYYDEKGIVTGAGIAAPHASELISEISLAVESGLMAMDIGLTIHPHPTVSEGVKESAEEVYGKPLHFKL

SEQ ID NO: 10818 - protein, 460 aa, Thermoplasma volcanium GSS1
MGYYDDMRHDDLNYEYLYGSTYPLMKNAGSSVAKVIEKNFASGQKVCVVCGTGNNAGDAIVAAELLRTKFEVTVLLVNGLKSELAKKALQEYGGNVVDASHIDECLAADIIIDGIFGVGISGEPKEPYKSTIEKINASGKKIVSVDVPSGLGTNCAVRPDITVTFTSLKYGMNKENSGEIIVADIGIPDDVRKYAGPGDLIYYPRPDPDSHKGMNGTLGIVAGWEYHGSSVIAALAAENLGLDLVRIYVTNKNYEIVSSYDPGIIVRLFDYKRQASYEEVWRNSALLIGPGLGTSHEAEIALKRLVNGSAVPIVIDADGITLLSKHLSIIKGKKIVVTPHKNEFRKLTGTEPNEENAVEFAKEKGIIIVLKGKVDIITDGKEVHYAKGGNARMTMGGTGDLLAGLISSFISKGIDPMRSCLMGTYLNKRIGELAYDKKGLFYKITDMIDEIPSVMASYVR

SEQ ID NO: 10819 - protein, 389 aa, Thermoplasma volcanium GSS1
MAEKRLFNGFNTRAVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDKASES

SEQ ID NO: 10820 - protein, 471 aa, Thermoplasma volcanium GSS1
MLSEKYDLVIVGRGAAAFSAAIRASEITSGQARIAMVGNGPLGGTCVNTGCVPSKLLISISNSFQNSLKPRYPGLPSVERPPETEVIMDFIRESVHGERKKKYEDVVESYENIDLYTGTAVFTGEKEILVDSSHSLFGYNVLIATGSRPYVPGIKGLNETSYITTDSVWELKHVPASIAILGGGAVGVEIGQALSRLGSEVHIIEVSNQILPGIPADMASIIERSLREDGMVINTSTSVDEVSGGEGKKYLKLNGTNINDTLEVEEILVATGRAPNIDLALEKTGVKYSKRGIAVDEYLRTSNRKIYAAGDVVDQKYKLETLAAREGFISAENMFNHAMRTIDIFNVPFAVFCSPGYASVGYTQDEATKAGIKTEARRISTKDVASERIHANREGIINIVAEADTKEIVGVQIVAENAPELINEASAILSKRFKTDDLINTVHVFPTENEGLKLATQSFSRDITMMSCCME

SEQ ID NO: 10821 - protein, 211 aa, Thermoplasma volcanium GSS1
MLVSPSIVAASLTKFQAQVKECEDAGAYSFHLDVMDGNFVPNITVGPDFYFALRSISKIPIDTHLMVDRPDYYYEKFLSQNDRVLIHYESPINIKGLIKKMENEGVKYGLVINPNTPFSKVSDLLERAEILLIMSVYPGFSGQKFIDVSEKIKEARNYIKEMGLRTMIEVDGGINENTAKIVKNAGADIVVSASYLFSGDITDRIKTLSSI

SEQ ID NO: 10822 - protein, 183 aa, Thermoplasma volcanium GSS1
MDQLINKYYEKCLAFAIPFDLKVTSDPCAYFRQGSTIDGISELFSYGSKMCDFRGQLDERVKEMARQILPNTTALVGERLAMDLLVHAHGLKRLAYMPSSSIQMLGAERALFTAIQKRGNTPKYGVLFKYPKLSTLRPRQRGKIARIIANKVAITARADLLGTKVDAESFREKIDNMIKSSKK

SEQ ID NO: 10823 - protein, 498 aa, Thermoplasma volcanium GSS1
MINTENFGNIINGTEEMVGDESIVKSPVDGSPIASVYFADRDAVSKAIDSSYDSYYKVWSKFTLSERKKLLAKLADRIQEKSERYATLESLNTGKTLRQSMLMDIPLGIEHLRYFATETEFKMERQITHPEYPDSHGIVQYVPMGVVGAITPWNVPFLMAVWKAAPALLAGNTVVIKPSSFTPLTTIEMARDAISVGFPPGVLNVVNGRGETVGEELARNKKVRMLSFTGSTYTGKRITEITGIKKVTLELGGKSPNIVFDDADLERAALGVMFGIYLNSGQLCESGSRLLVQSSIKDKFLNLLKSKIEKMRPGNPMSMETDISAITTKNQRDKIEKMVNSGLKDGSVIFYQKSIDGSVPKGGLYFPPTILDKVSEDMEVAKEEIFGPVLSVMEFDDEADAIDKANMTDYGLAAGVWTQDSEKATRVASSIEAGTVWINEYHLLSAAAPRGGFKNSGVGRELGLDGIMEFTQTRHLFVSHGSTDQDTVAYGLVLADLS

SEQ ID NO: 10824 - protein, 273 aa, Thermoplasma volcanium GSS1
MKLIENWFSERYSDNLQLSFRVSDQLLSIKTDYQRIDLFDTYDFGKLLAIDGTVQLTERDEYIYHELITMIPYHMTKNPPQSALVIGGGDGGAARRLLDLGLNKIVNVEIDGQVVEVSKRFFPDLSSAFTDKRVNLIIDDGIKYVRKCNEKFDLVIIDSTDPEGPAEGLFSMEFYSDITKILSDGGVIVSQSGSPFYQPKALKLAYTGMRRLFKDVKVYTGFIPTYPSGFWSFTIASEDAMNPRKPAIKGKYFNEDVLDGVFKLPQFVKDLIT

SEQ ID NO: 10825 - protein, 445 aa, Thermoplasma volcanium GSS1
MGFFDDMDRMGIRPFHRKIEILASMGMFLDGYDLSVITMAILLMPTQLHFGKLDYILVNVSAFIGMIIGAPLLGRLSDRIGRKKIFGIDLLLFVVFAITAGLATNFAMLFISRLMLGIGIGGDYPISSTMVSEFSPVSKRGTLLYGMVGMYWLGSFFSAVMNYTFAFTPYFWRYTFIVGGVIAIPIIFLRMRIPESPRWLIGHGMTKSAESVVEDLTGRKPDVEEGKAEAEQEESVKFSSLFSSKFLASTIFVLSVWFLFDVASYGIGFYYPTLIDKLGLASHVLNTAGLRAIAESSMIVAVGAILGYLVAMPLADRIGRRILTISGLFVMFLLLLLGSVVKISTLLPVVAFFFSFVLFEQWVGAATLFYPTELFPTNYRSTIQGIATSVSRVGAIMGIVVFPLYPVFHSIFIFAILMALALIISVIFAPETKKTPLEKIWKSKA

SEQ ID NO: 10826 - protein, 365 aa, Thermoplasma volcanium GSS1
MAKDYYKILGVDRNASEEDIKKAFRELAKKWHPDLHPDNKAEAEEKFKEISEAYEVLSDPEKRRIYDQTGSVDFGGGGSNFNWDNFTHFSDINDIFNEIFGGNFGSDFFSGFGNRQSTRNIDLDMYTNLDISLEEAYYGTEKRIKFRRNAICPDCKGTGAKNGKLITCPTCHGTGQQRVVRGQGFFRMVTVTTCNTCGGKGRIPEEKCPRCNGTGTIVVDEDITVKIPRGATDNLRLRVSGKGQSYDGRTGDLYVILRIKQDKNLQRINDDLLLDQKINFGQAALGADIPIQIFNEKYNLKIPEGTQPGDVIKIKGAGMPHLNGHGSGDLLVRINVEVPKRLTAKQRELIRELFDIKENHKSWFH

SEQ ID NO: 10827 - protein, 408 aa, Thermoplasma volcanium GSS1
MADFFLMDSFDLAGRTIYLRVDINSPVNPVTGEIMGTDRFRAHVETIRKLRDSKVVIVAHQSRPGKDDFTSLRQHAQVMSRILNKKVMFVDQLFGSLVNKTVESMNEGDIVMLENARFYSEEVDLTTLESMENSNIVKGLSTLFDYYIIDAFAAIHRAQTTLVGFRRIKPNIAGALIEKEVTMIDRFRHLNESPKIAILGGAKIDDSIAVSENFLKSGFVDKILTGGVVANAFLWAKGIDIGKKNRDFIIKNNGDYEKLIAKCKGLLSEFGDRILVPSDFILSPSGERVSANGKIPDDQILADIGLDTVVEYSEIIDKAKAIFMNGPMGIYEIEAYSSGTREIFSSVAKSEAFSIAGGGHTLSALDKLGLTNRIDHASTGGGALISYLSGEAMPVLEALKESKRLFEV

SEQ ID NO: 10828 - protein, 303 aa, Thermoplasma volcanium GSS1
MGGNGREKDHASELRSIFSLKKIADAVNGYEEAKYVVFGIPFDNTSSYRRGSKYAPDSIRGAYVNLESYEYSYGIDLLASGMADLGDMEESEDVEYVIDTVESVVSAVMSDGKIPIMLGGEHSITVGAVRALPKDVDLVIVDAHSDFRSSYMGNKYNHACVTRRALDLLGEGRITSIGIRSVSREEFEDPDFRKVSFISSFDVKKNGIDKYIEEVDRKSRRVYISVDMDGIDPAYAPAVGTPEPFGLADTDVRRLIERLSYKAVGFDIVEFSPLYDNGNTSMLAAKLLQVFIASREKYYKEHI

SEQ ID NO: 10829 - protein, 309 aa, Thermoplasma volcanium GSS1
MMHAELGPDMVSKILDHMKAAHIGNTPVEEIDANGNIYAKIEWENRFGSIKDRPAFFIMDYLKSKGVLEGKAIVEASSGNTGLAISTISSMLGLQSCIVLPENASQATKKIIVENGSQLILTPPDLGTEGSIEKARSLASSGSFYWINQHSNPLNSDVHYYSTAPELLDQEGMPEAIVAGVGTGGTITGIARYFKERDPSVKVIGVQPSLYSHIPGLRDIKKTSNKGLIDLYGSYIDDFLYVKESDAIAEVFDHYVNTGELIGISSGANLYASKQLSSKFKKIFTVFPDSGRKYLDILKPYDKNNVLNY

SEQ ID NO: 10830 - protein, 420 aa, Thermoplasma volcanium GSS1
MSSKELFELAAKLFPMGVNSPVRYFKDYPFYVKEGKGSTILDVDGNKYIDYCLGYGPLILGHSDPDVTRAVIEQAEKGLLFGEPSENEIKLAEMIKETSKNIEMMRFTNSGTEATMHAIRLARAITGRKLIVKMEGGFHGAHDYSLIKSGSGTLTFGSPSSPGIPDEVAQTVIVGKYNDENNIKEIFQKYGDKIAAVITEPIMGNAGVILPKQGFLEFLRDITQKHGSLLIFDEVITGYRFAFSPFQDIMRIDPDITTMGKIIGGGLPIGLFGGSEEIMKNISPSGNVYEAGTFSGNPMSMAAGYAAMEKLSKQDYSILKKRTQKLVSGIDDILDRKHITHTIKYYGTMFQVFFADHVNNYDDALKARKEVYFKLFKALSKNGVYLPPSQYETNFVSFAHSDSDIDATLAAFEKAVAEMD

SEQ ID NO: 10831 - protein, 417 aa, Thermoplasma volcanium GSS1
MLLNEEEKQIRDLCRRVVKEVPHELIRKIEREEVTFPREFIDFITKNGVVGLRFPKEYGGKGASWVAEASAVEEMGYLGFTLSCMYSLGTIVGEPMYRYGTNEQKEKYLKGITSGKLYGAEAITEPSGGSDLFGMMKTTAVKKGNKYILNGQKRFIVGGKGADFFVTYAITDPNAKSRTRGISAFIVDRDTPGLKVETLYGLMGNKGGGTARIVYKDAEVPEENLIGELNGGYEVFNRMMIPERLTTAAGSLGVSTAALKVATDYALKREAFGSKLIEHEGINFKLAESLTLLQSASALVYTAAKAADLYEKGQTTQSYARKLVSMAKLHSTEAMWKIVNDAMQIMGGIGYTTVYPIERLLRDSRLGLIWTGSSEVMKMIIQHEYLKEFTNPDYWESRRDIEKDALDFRLEEEKVFK

SEQ ID NO: 10832 - protein, 481 aa, Thermoplasma volcanium GSS1
MVENNFPEDFKFGWSQSGFQSEMGYDNAMDDKSDWYVWVHDKENIQSGLVSGDMPENGPGYWNNYKSFHEAAQNMGLKMARIGVEWSRLFPEPFPEKIMADAKNNSLEINNNILSELDKYVNKDALNHYIEIFNDIKNRNIDLIINMYHWPLPVWLSDPVSVRKGIKTERSGWLNDRIVQLFALFSSYIVYKMEDLAVAFSTMNEPNVVYGNGFINIKSGFPPSYLSSEFASKVKNNILKAHSLAYDSMKKITDKPVGIIYANTYFTPLDPEKDNDAIAKADSDAKWSFFDPLIKGDKSLGINGNKLDWIGINYYTRTMLRKDGDGYISLKGYGHSGSPNTVTNDKRPTSDIGWEFYPEGLEYVIMNYWNRYKLPMYVTENGIADNGDYQRPYYLVSHIASVLRAINKGANVKGYLHWSLVDNYEWALGFSPKFGLIGYDENKKLYWRPSALVYKEIATKNCISPELKHLDSIPPINGLRK

SEQ ID NO: 10833 - protein, 305 aa, Thermoplasma volcanium GSS1
MPIDPQVRKYLDAMSKVSVPELNKTPIEDLRKIFDTPASGAPKVKISVVEDMILDTDAAKLPARLYDDSNSDSLVLYFHGGGFVFGSIETHDSLCRRIAKYSGSKVISVGYRLGPENKFPVAQIDAFNSYLYVLKRSEELGVDSDKIALMGDSAGGNLAAVASLMARDKGIKLPRLQVLVYPSTGPDMTSKSYLEYSSIYLTKELLNWFSSQYLNSIEDALNPYFSPILADLSGLPEAIVVTDEYDPLLEQGETYSATLRDSGVPVTSIRVNGMIHGFLSNFHLFRAADVSLMMISGAIHTILES

SEQ ID NO: 10834 - protein, 435 aa, Thermoplasma volcanium GSS1
MKIIVIGGGAAGMSAASKAKRVNPDSEVIVVESGSYVSYAECGIPYYLQGVVGHIEDLLHYPLSEFTEKRGIKVLLHTTVTRIDTLHSSVLLNNGDVLKYDRLIIATGSRPKPIDVISDRTISIRSLESAMRARNLIEKSKDVTIVGAGVLGVELASVLAESGKNVKVISKYDRVLPQLDEDIGKIFHEYFSSRIDVQKQSSLKSAEEDRGRVKITTSVDDHECDAVIYATGIIPNSEIAVEAGIKTGDRNAILTNGHMETSEPGVYAAGDVATVRNIVTGLDEMMPLAQIANKAGRVAGSNASNSEMVFPGALGTTLVKVFDYEVGFTGINESRAKALGIPYEKTLIKAKSRANYYPGKQDIYVKIIYGKNDKRLLGAQVIGTDGAAWRLNTIATAIFGGFKVSDLFYDDLGYTPPFGPVWDSIVIAGSVSMRE

SEQ ID NO: 10835 - protein, 343 aa, Thermoplasma volcanium GSS1
MTDILPEYRKKHPYVMYEMMKQIPEGIDKTLKAAQSVDYSFLGDDITFIGNGTAYHAGYIGSGIIEKYGLRRRVVQAYEYLNYLKYSSSFIGISHTGKTKSTVDAMLKARITGKTAGITHYRDSPLYNSVDVPILIEDEDKSLCNTKAFFNSAFAALYVSSIYLGKDIDFKSLRNEIAKHVNDDDKEMESASAELDNVKDIFVLGSGPNFPVAREAAQKIREATHLHAEGIELEEFNHGCTAVMDENTLVILVETERDKERANQIVRASSYVGSPTMAINGDAEISYYSDYQDEYLSPFVNMVPLYYLAYYLAVRRGINPDYLRFEDERYRNYDNTVFPPGAH

SEQ ID NO: 10836 - protein, 268 aa, Thermoplasma volcanium GSS1
MSTGYLGPKMSYSFLATSKMGYNDGVPFKTIFDLFDAVEKGGIDRAVVPVENSLEGQVGQTLDLLFSKDVSIIEEYYLRVVHCIAATDNADVKIVHSHPQALMQCSNYIEKHGYAVIEETSTTAGIEKLFNEQNKGHAVICSEEAASACKLTILDRDIGNEHDNFTRFFVITKKGLAKPQGDKISIAFTLLNKPGSLASIVDVLAKYGIDMTKIESRPIKFNPFSYIFYIDFIDNGFSKQAMDEISQKTVSLKILGKYRKAIGPVMKQ

SEQ ID NO: 10837 - protein, 303 aa, Thermoplasma volcanium GSS1
MHVYVNFPVEDKFKKIGESILDNYDVHWYPDYYDADAILIKNTYVIGKNTKMIQTLSAGVDHIDVQGIPENVVLCSNAGAYSISVAEHAFALLLARAKNVIENDMNMKNGKFIQSPTKLLYSKTLGILGYGGIGRRVAELGKAFGMDIAVFTRTLVKEGGVRFYKEPGPVLENSDVVVISLPLTDNTRGMINSSKLEMMKKDAMLINVARADIVVKEDILKHLISNPDFTYISDVWWNEPNITETNIKNTILSPHIAGGMSGEIMELAYEQAFRNIKAFFEGKPNNIVRKEEYKKRNERFVGI

SEQ ID NO: 10838 - protein, 401 aa, Thermoplasma volcanium GSS1
MELPIEDVRVRKVLDSRGNFTVEADVYIPGGFGRTSAPAGASTGETEVIAFSKKGIDESIKFFETNVRRSIIGFNALDQKGFDALITDLDGSGNFSNLGGNLSTALSMSVAKAVSAHLGIPLYRYVGGINHSMPRPIGNVIGGGKHARNGTSIQEFLVSAQGKTFMESAYVNVLVHRKIGDILSEKMKDISIGVGDERAWSVNISDEEAFEVLNQAVNEVSSETKVKIYTGLDFAADSLYENGKYVYKHTVRSRDEQIDYAISINKDFGVYYIEDPMFDTDFEGFAEITKKIGDKAMIVGDDLYTTNPDRIRKGIELGSTNAVLIKVNQIGTLTKAQEAASLASSAGLKNVVSHRSGETTDDFLAHLSVAFSSTFVKTGTIGGERIAKLNELMRIEECLTS

SEQ ID NO: 10839 - protein, 372 aa, Thermoplasma volcanium GSS1
MPTRLPIKDRFDDHAHSLSFPVFFTSSYDSRKDRKYRYSRELNPTVEELSRQLSLLENTERSICFSSGMGAITGTILALAKPGDKLVMPTDVFGRTYLFAKNFLTKFGINVKFVEPGTDSLLGAVEEHADIVFFESLSNPLLRLYDVDRICRKASDIGAITIVDNTLATPILLKPSLYGCDIIIESLSKFIGGHNNAIGGSASGSLMMDTIDENRRSLGSSMDPMSAYLFILGLKTIDLRIKRSSETAKAIARFLNENNFVSKVYYPGLSDNSDNISAKTLLNGSPPIVSFLLDEGKDVQKFMESLRIITPANTMGGSNSTISNPYTMSHRNLSEDEKLRLGITKNLMRLSVGLEDLDQIIQDLEQAIKYAQ

SEQ ID NO: 10840 - protein, 493 aa, Thermoplasma volcanium GSS1
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 10841 - protein, 435 aa, Thermoplasma volcanium GSS1
MIQLLNNLWVLFSAFLVFLMTIAVGFLEYGELGIALKRSLYKTILITGIAFVVMAVIGFNTAFAPTLYGIIGNPLYKPGFVLGYLNSPTAMFSTIWWATSASYFNTGLLGITYFLFETAFASVTLALVSVVILRKVKMSVFVVFSIVYFIVIYNLPAAWIWNPTGWLYLLGMRDFAGGLVVHGAAGFAGLAIIIRIWQEERKKGIVRSPGEIIKVNDGFLTLAILLLMMGWFGFNPGSVLAFNYDTLIVVMTTFMAALTSMLSTLTVSYLLYKDAGGIMNAVNGILMGLIIVTPLAGFVSPLSAAILGILGGPIFIFANRFFSKRKWFSDPVGLFSGHFTGGIFGVLMIGFFTQHSYAVLSGNSILPNGLFFGGGYLALHTLGIEIMGICAVGLAVFAISYATMYFLSLGFHGILEEPEWKKEERKSLPSSETSK

SEQ ID NO: 10842 - protein, 222 aa, Thermoplasma volcanium GSS1
MSKGDRPGLLLPFENKRIIRIRNSVYTETETPQRVYGEEITKINNRTYREWDPRRSKPAAAILNGLRRFPIRENDSVLYLGASTGTTISHISDICPAGTIYGVEVSYEPFSKLLDLAKKRNNLYPILEDANSPEKYSFFIEHVDVMYQDISQRNQIQIFKNNVNTFNPKRGFLVLKIRSVKSTEDSRSILNTAMDQLSVYHLKEVINLKPYDTDHYLITLDT

SEQ ID NO: 10843 - protein, 384 aa, Thermoplasma volcanium GSS1
MANFGVSPEEEMVLTYVKKFAQEELKPRAKEIDAKMEVPREIIDRMKQLGFFATYIPKEYGGLGMSFPFLIRAIEEISKACPSTALVLDGALTLFAEPIIMFGSEDLKKRYLTRVASGSVGGLAITEPGAGSDAAGISTTAEKRGDKYIINGDKIFISNGRISDFFVFDAVTDPGKRHKGITAFVVDANTPGLKISRDIHKMGIRGSSTVELVFEDMEVPAENIVGELNGGFKVIMETLDAGRIGIAAQALGIAEEAFAEAMDYIKQRKQFGTTISSFEGIQFMIADMATEIEAARYLTYVAAEKWQHKEDTIEISAMAKLKASDVAVRVTTDALQLFGGYGYTVDLDAERHMRDSKITQIYEGTNQIQRLVIAKELLKKTNYY

SEQ ID NO: 10844 - protein, 484 aa, Thermoplasma volcanium GSS1
MLSFERVRIRKADPVKRVGTFELEPLENYNDGEAIAEASRCIGCNMCSAACPASLDIGGYVRSTAAGDPAQTIRIIMETLPFPAIIGRVCTHMCEDVCVLYDGGGPIAIRHLKRYAADKFDDYGEILKPQKRKFIGKRVAVVGGGPAGLTVAYYLTLQGVKVTVFEERPALGGFMKTGIPRYRLPQNVLDKEIGYILSRGVQVKLNTAVGRDVKFEDLMKEYDAIFLGVGNHKPRMTGTPGSDAPNVMHATEFLERVSFGEKINVGETVAVIGGGFTANDSARTSLRLGAKHVYIMYRRRDVDRPGYPSMNADEEMEEAEEENVEYVWEVTPFEYVKENGRVVAMKYWKNEMVSQGKGRAKPVPIKDKFYTIKVDMVIEATGQETDYSFLGSYVEKLRLNDRGEPIVDQYGMTSIPGVFTGGDSTNPNRDLISAVRDGDIAVQGILRYLNVMDQVSYDDLPLLDRFKPYSYTAAAEAYASRGLE

SEQ ID NO: 10845 - protein, 309 aa, Thermoplasma volcanium GSS1
MKVSAVLPNFLPVGEIRKLAASVLPDINIITDLDFKSDESDILIVTAFTKVDKALLDKFPRLKFIQVASTGYDNVDVTEVKSRNILMCNSPSSNKESVAEHVIGMALYFLKDFGHLDREIRNGNWPILTFSRDLMGKVFGIIGMGAIGRKLAERLIQFGVGIIYYDVKRLPEEVEDELGITYVTLDELISSADIISIHVPLTETTKGMIGRKEFEKMKDGCIFINTSRAEVVVTKDLVWALKQGKIKAGIDVYDREPPDFSSELFQMDNALFSPHIAGVTVESQRRFIEETVANVIRYMQGVDPLNRVL

SEQ ID NO: 10846 - protein, 392 aa, Thermoplasma volcanium GSS1
MKMFNIASEDDIKKGLASDVYFERSISTLTETCKDHRVAMEATVSGPLDTWINFSGLDEVLKLLEGIDVDVFAIPEGTILYPRDSNGIPVPFIRIEGNYCDFGMYETSILGMICQASGISTKSSKVRIAAGDCPFFSFGIRRMHPAVSPMIDRSAFIGGADGVSGILGAKLIGEEPIGTMPHALSIILGDDEAWRLTLKNTKNGQKSVILIDTYMDEKFAAIKVAEEFEHVDYIRLDTPSSRRGNFEALVREVKWELALRGRSDIKIMVSGGLDENTVAKLREAGAQAFGVGTSISSAKPFDFALDIVSIDDKPKTKRGKLSGKKSVLRCEKCRKVEVVPYGVESKPCSCGGVMHNIIVKYMEHGKLLSQYPEPKEIRKRTLSELEYFRSSN

SEQ ID NO: 10847 - protein, 246 aa, Thermoplasma volcanium GSS1
MIDGLLITELNKLTPGSSYIFLDYDGTLVPIIMNPEQSLADPELIEMLTELRSKYKLFIVSGRSPEEIKRFIPLDLNLICYHGACSIVNGKTYYYNNAQSFLGIFNEIYQSSLNLVNEFPGLRIYKKNLAVLYHFGLMKPQDVPALERVIVEISQKEHVDVYKGKMIFELRVPGVNKGIAIKNVRDEETALIAGDDATDECSFKYNEDAITIKVGPGKTSAHFRVNDYSEMREVLKLLLNNAEKRS

SEQ ID NO: 10848 - protein, 382 aa, Thermoplasma volcanium GSS1
MHSYVDADDLLRNSIKEFVKKEVEPIRMKIDREDYFPVDVFKEMGKLGYLGVTIPQEYGGSDAGYITQAVIEEELGYSSPSLALSYGAHSNLCLDNVYRNGSQAIREKFVPKLASGEWIGSLCLTEPGSGSDALAMHTTLHDHGGRIFLTGSKTFITNGPYADLFLVHAKDGDSYTSVIVLSSDKGFERGKKFEKMGMRGSPTGELFFNDIDIGNERIVGKRGDGKRIIMSGLNSERVILAFIFVGLARRALDEAVKYSSERKQFSLPISEFELIQEKLAYMYTKYETSRILAYRALEKLESSRDDPLYAAAAIMHASESAEYIAREAIQIFGGYGYIKDTGIEMFLRDAILGQIGAGTTEIRKRIIAKSLIRKYKLGEDIN

SEQ ID NO: 10849 - protein, 369 aa, Thermoplasma volcanium GSS1
MNFELDENLLNFRKKIEEFAKREFTEDLASKYDEQEHYPEDVFTKMMSEGIFDYTNPWNILMATEALCKYDAGMGISMLVPFFGNEVIALFGNDEQKKKYLSRVFAGKAKMGLAVTEPGGGSDVANIKTTAVKEGDHYVLNGSKMFITNGDIADFFVLLARTSQEKKKHHGMSVFIVERDFEGFRSNKIKGKLGVRATDTAELTLENVKVPEENLVGEPGRGFYYIMTFFDISRAYVAAQALGIAEGILERTLSILQKDGPLTSQPERVQFTIADMATRIEATKLLTYEAASYIFNFNPNPAVTSMAKAYAAETAVYVSRKAMEVTGIDGLTSSIERSFRDAKIMEIWEGTSEIEKLVIARMLKTGDVQ

SEQ ID NO: 10850 - protein, 480 aa, Thermoplasma volcanium GSS1
MEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 10851 - protein, 366 aa, Thermoplasma volcanium GSS1
MLCLSEEQSIIKGSIAEFTKRRIEPIEKRIEDDDYFPMDILREIGKNGFFSVMLPGIGVQDTYSFSLIAEEISKVSPEVAWLYVTHVAASYALDKLGTEEQKDSYLRKMADGEIIGTIAITESSSGATASAIASSARKYEENWILEGSKTFITMGGDADLYAVLAKTHEDPAAFTTFIVLKSDVGLELGTHLIGSAMKGIGWGEISFNNLILEKHRILGKENEGIKIIPTIARIFSIGAASISLGIMERALELVSSHVKERKIACKSLLSNQTVQDKLFHLYADTEAARSLVYRASINDDIRLAYSAKLFSTERSIAVTESAVSLFGATGYEESLAIPKLLNKAIAVPLHFINNAILTGLFITAID

SEQ ID NO: 10852 - protein, 485 aa, Thermoplasma volcanium GSS1
MYRDKFSNITEGYTFDDVLILPMKTGVEPKNVDVSSRLSRRINVKVPIVSSPMDTVTEEAMAIAMARYGAFGIIHRNQPREKEVEMVRRVKREETIIIRDVYTVSPETPIEVARTIMKTKNIAGLPVLKEEKLVGILTKRDLEFAKQGSTVSDVMVKNVITAPENVDLEDAINILHKNRIEKLPLVDKDNHLVGLITAKDIITRQRFPDATRDDEGQLMVGAAVGPFDLDRAIELERAGADLIVVDTAHADNENVLSSIKRMRKEISVDIVAGNIATAGAAEDLISCEVDGLRVGIGPGSICTTRIVAGVGVPQLTAISEVAEVAKEYGIPVIADGGIRYSGDIVKAIAAGADSVMLGSMLAGTEESPGQEMIINGRKYKAYRGMGSIGALSTGISDRYSKLGNGFIAEGVEGAVPYRGRVDEVLFQLVGGLRTGMGYVGAENIGKLKERARFVRISSNGLRESHPHDIRLISEPPNYQISNYNL

SEQ ID NO: 10853 - protein, 450 aa, Thermoplasma volcanium GSS1
METYDVITLGAGGAAYPAAFRLKKSGYSVLMIDKKGIMSGNCLAEGCVPSKAIIETVHNYSKLKKFGKYSIAYEDIVKHKDDVQNIRYKQHDEELHEAGLKILKGTAKLIDENTVEVETDTGKERYRAESIIIGTGSDTYVPKIPGAELAWTSRELYALNPKVRKLPKSIAIIGGGYIGLETASFMSLLGTDVTVIELLDRVLSTMDSGMVSKLVPLLPKMNLILSSPVKEIRRGGDMFEVSYDHEGKTEKIRVEAVLMAVGRMPMFPEGLDDLGIKYDKHGIKVNMAMQTNIKHIYATGDVNGLTPLFHAAKRQSLVAANNIMANHVPVDYFDPLSVPFTVYTVPQVAYVGILPDQAKKLGISYIETDYQMEKDAMAQVNSEMEGEIRLFFDSRMKIIGGYVIGNDAGNLINEIALGISKGLSARDFAEMAHQHPMSFEGLDSAARKLY

SEQ ID NO: 10854 - protein, 445 aa, Thermoplasma volcanium GSS1
MPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 10855 - protein, 195 aa, Streptomyces sp.
YPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 10856 - protein, 486 aa, Cycloclasticus oligotrophus
MQHINHFINGEFVSAVDGKSFEKRSPVDRRLIAQVSEGGKVDVDRAVHAARAALNGEWGAFTMEQRVEILYGVADEITRRFDDFVEAEMADTGQPKSIMTHAFIPRGAANFKIFADVIKNVPNESFQTTTPDGLGALNYAIRVPKGVVGVVSPWNAPFLLMTWKVGPALACGNTVVVKPSEETPLTTTLLGEVMNKVGVPKGVFNVVHGFGPDSAGEYLTHHPKVDAITFTGETTTGAAIMKAASEGMRDVSFELGGKNAGIVFADSDFDKAVDGIYKSSFLNSGQVCLGTERVYVERPIFDKFVEALKKKVEKVRHGRPDDENCNFGPMISHEHQAKVLSYYAKAVEEGATVVTGGGVPSIPEELKEGAWVEPTIWTGLAEDATVMKEEIFGPCCHIAPFDDEQQVINWANDTEYGLSTTVWTRDLSRAHRVAAKINVGITWINSWFLRDLRTAFGGSKQSGIGREGGVHSLEFYTETRNVCVKL

SEQ ID NO: 10857 - protein, 506 aa, Ruta graveolens
MDLLLLEKALLGLFAAAVVAIAVSKLRGKRFKLPPGPLGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 10858 - protein, 174 aa, Neisseria animalis
FITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHIAYNPPKVEGKDDVTGEDLIQRDDDKEETVKKRLDVYHGQTEVLVGFYSKLTGEHAPK

SEQ ID NO: 10859 - protein, 174 aa, Neisseria cinerea
FITAAFDIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPK

SEQ ID NO: 10860 - protein, 174 aa, Neisseria flavescens
FITAAFGIPQISTGDMLRAAIKAGTPLGLEAKKIIDEGGLVRDDIIIGMVKERIAQDDCKNGFLFDGFPRTLAQAEAIVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPK

SEQ ID NO: 10861 - protein, 174 aa, Neisseria polysaccharea
FITAAFGIPQISTGDMLRAAIKAGTLLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPK

SEQ ID NO: 10862 - protein, 174 aa, Neisseria pharyngis subsp. flava
FITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPK

SEQ ID NO: 10863 - protein, 466 aa, Jeffersonia diphylla
  misc_feature (19)..(19): Xaa can be any naturally occurring amino acid
  misc_feature (122)..(122): Xaa can be any naturally occurring amino acid
  misc_feature (207)..(207): Xaa can be any naturally occurring amino acid
SAGFKAGVKDYKLTYYTPXYVTKDTDILAAFRVTPQPGVPPEEAGAAVAAESSTGTWTTVWTDGLTNLDRYKGRCYGIEPVAGEDNQYICYVAYPLDLFEEGSVTNMFTSIVGNVFGFKALXALRLEDLRIPVAYVKTFQGPPHGIQVERDKLNKYGRPLLGCTIKPKLGLSAKNYGRAVYECLRGGLDFTKDDENVNSQPFMRWRXRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARZGNEIIREACKWSPELAAACEVWKEIKFEFEAMDTL

SEQ ID NO: 10864 - protein, 457 aa, Oryza sativa (japonica cultivar-group)
MEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 10865 - protein, 256 aa, Phaseolus vulgaris
MATRRYSFGRTDEATHPDSMRASLAEFASTFIFVFAGEGSGLALVKIYQDSAFSAGELLALALAHAFALFAAVSASMHVSGGHVNPAVSFGALIGGRISVIRAVYYWIAQLLGSIVAALVLRLVTNNMRPSGFHVSPGVGVGHMFILEVVMTFGLMYTVYGTAIDPKRGAVSYIAPLAIGLIVGANILVGGPFDGACMNPALAFGPSLVGWQWHQHWIFWVGPLLGAALAALVYEYAVIPIEPPPHHHQPLATEDY

SEQ ID NO: 10866 - protein, 506 aa, Helianthus tuberosus
LGNRQYEHFNKIAKVVDDGLVEQGAKRLVPVGLGDDDQCIEDDFTAWKELVWPELDQLLRDDDDTSVATPYTAAVAEYRVVFHEKPDMYDENSQTNGHAVHDAQHPCRANVAVKKELHSSESDRSCTHLEFDISHTGLSYETGDHVGVYCENLSEVVDEAERLIGLPPDTYFSIHTDKEDGTPLGGASLAPPFPPCTLRKALASYADVLSSPKKSALLALAAHATDPAEADRLKFLASPDGKDEYSQWIVASQRSLLEVMEAFPSAKPPLGVFFASVAPRLQPRYYSISSSPRMAPNRIHVTCALVYEKTPAGGIHKGVCSTWMKKRVPMTECLDCSWAPIYVRTSNFRLPSDPKVPVIMIGPGTGLAPFRGFHQERLALKEAGTELGSSILFFGCRNRKVDFIYEDELNNFVETGALSELIVAFSREGPTKEYVQHKMNEKASDLWKLLSEGAYLYVCGDAKGMAKDVHRTLHTIVQEQGSLDSSKAELFVKNLQCRGRYLRDVW

SEQ ID NO: 10867 - protein, 227 aa, Rosa hybrid cultivar
EVYHADWNGTEVAVKKFLDQDFSGAALAEFKREVRIMRRLRHPNVVLFMGAITRPPNLSIITEFLPRGSLYRIIHRPHCQIEERRRLKMALDVARGMNCLHSSNPTIVHRDLKSPNLLVDKNWNVKVGDFGLSRLKHNTFLSSKSTAGTPEWMAPEVLRNENSNEKCDVYSFGVILWELATLKLAWSGMNPMQVVGAVGFQNRRLDIPKEVDPPVARIIWQCWQNDP

SEQ ID NO: 10868 - protein, 1147 aa, Saccharomyces cerevisiae
MPNPNTADYLVNPNFRTSKGGSLSPTPEAFNDTRVAAPATLRMMGKQSGPRNDQQQAPLMPPADIKQGKEQAAQRQNDASRPNGAVELRQFHRRSLGDWEFLETVGAGSMGKVKLVKHRQTKEICVIKIVNRASKAYLHKQHSLPSPKNESEILERQKRLEKEIARDKRTVREASLGQILYHPHICRLFEMCTMSNHFYMLFEYVSGGQLLDYIIQHGSLKEHHARKFARGIASALQYLHANNIVHRDLKIENIMISSSGEIKIIDFGLSNIFDYRKQLHTFCGSLYFAAPELLKAQPYTGPEVDIWSFGIVLYVLVCGKVPFDDENSSILHEKIKKGKVDYPSHLSIEVISLLTRMIVVDPLRRATLKNVVEHPWMNRGYDFKAPSYVPNRVPLTPEMIDSQVLKEMYRLEFIDDIEDTRRSLIRLVTEKEYIQLSQEYWDKLSNAKGLSSSLNNNYLNSTAQQTLIQNHITSNPSQSGYNEPDSNFEDPTLAYHPLLSIYHLVSEMVARKLAKLQRRQALALQAQAQQRQQQQQVALGTKVALNNNSPDIMTKMRSPQKEVVPNPGIFQVPAIGTSGTSNNTNTSNKPPLHVMVPPKLTIPEQAHTSPTSRKSSDIHTELNGVLKSTPVPVSGEYQQRSASPVVGEHQEKNTIGGIFRRISQSGQSQHPTRQQEPLPEREPPTYMSKSNEISIKVPKSHSRTISDYIPSARRYPSYVPNSVDVKQKPAKNTTIAPPIRSVSQKQNSDLPALPQNAELIVQKQRQKLLQENLDKLQINDNDNNNVNAVVDGINNDNSDHYLSVPKGRKLHPSARAKSVGHARRESLKFTRPPIPAALPPSDMTNDNGFLGEANKERYNPVSSNFSTVPEDSTTYSNDTNNRLTSVYSQELTEKQILEEASKAPPGSMPSIDYPKSMFLKGFFSVQTTSSKPLPIVRHNIISVLTRMNIDFKEVKGGFICVQQRPSIETAAVPVITTTGVGLDSGKAMDLQNSLDSQLSSSYHSTASSASRNSSIKRQGSYKRGQNNIPLTPLATNTHQRNSSIPMSPNYGNQSNGTSGELSSMSLDYVQQQDDILTTSRAQNINNVNGQTEQTNTSGIKERPPIKFEIHIVKVRIVGLAGVHFKKVSGNTWLYKELASYILKELNL

SEQ ID NO: 10869 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 10870 - protein, 508 aa, Saccharomyces cerevisiae
MKLQLAAVATLAVLTSPAFGRVLPDGKYVKIPFTKKKNGDNGELSKRSNGHEKFVLANEQSFYSVELAIGTPSQNLTVLLDTGSADLWVPGKGNPYCGSVMDCDQYGVFDKTKSSTFKANKSSPFYAAYGDGTYAEGAFGQDKLKYNELDLSGLSFAVANESNSTFGVLGIGLSTLEVTYSGKVAIMDKRSYEYDNFPLFLKHSGAIDATAYSLFLNDESQSSGSILFGAVDHSKYEGQLYTIPLVNLYKSQGYQHPVAFDVTLQGLGLQTDKRNITLTTTKLPALLDSGTTLTYLPSQAVALLAKSLNASYSKTLGYYEYTCPSSDNKTSVAFDFGGFRINAPLSDFTMQTSVGTCVLAIIPQAGNATAILGDSFLRNAYVVYDLDNYEISLAQAKYGTGKENVEVIKSTVPSAIRAPSYNNTWSNYASATSGGNIFTTVRTFNGTSTATTTRSTTTKKTNSTTTAKSTHKSKRALQRAATNSASSIRSTLGLLLVPSLLILSVFFS

SEQ ID NO: 10871 - protein, 345 aa, Arabidopsis thaliana
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYDVDGKKEKLKKKQDEEEEEDSEEEGEEGSEEDGEDMDEDFED

SEQ ID NO: 10872 - protein, 300 aa, Saccharomyces cerevisiae
MVNNSQHPYIKDGWFREINDKSFPGQAFTMTVDSILYEARSEFQDILIFRNKVYGTVLVLDGIVQCTEFDEFAYQEMITHIAMFAHSNPKRVLIIGGGDGGVLREVAKHSCVEDITMVEIDSSVIELSRKFLPTLSNGAFDDERLDLKLCDGFKFLQDIGASDVHKKFDVIITDSSDPEGPAEAFFQERYFELLKDALNPNGVVIMQSSENFWLNLKYLHDLKNTAKKVFPNTEYCYTMVPTYTSGQLGLIVCSNNANIPLNIPQRKISEQEQGKLKYYNPQIHSSAFVLPTWADKVINE

SEQ ID NO: 10873 - protein, 317 aa, Clarkia lewisii
LVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPAQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 10874 - protein, 466 aa, Zymomonas mobilis
MADHFDLIVLGGGPGGYVAAIRAAQLNLKVALVERVHLGGICLNWGCIPTKSLLRSAEVYHEMQNAEAYGLTSFKPDFDLDKIIARSREVAARLASGVKTLLRKNKVEVISGVGQLTGNQQMRVETTEVEEKILEAKDIIIATGARARQLPNVHSDGKHIWTYHHALKPPAMPKKLLVIGSGAIGIEFASLYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEDIAGCDHVHPLNTQNIPACTYARPQVASVGLTEEKARQQGYNVKIGNFPFIANGKAIAQGATDGFVKTVFDADSGALLGAHMVGAEVTEMIHGYTVARTLETTEAEIMETIFPHPTLSEAMHESVLAAYGRALHF

SEQ ID NO: 10875 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 10876 - protein, 355 aa, Gibberella fujikuroi
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDLGSALDLLEKLLAFNPVKRITVEEALKHPYLEPYHDPEDEPTAPPIPEEFFDFDKHKDNLSKEQLKQLIYQEIMR

SEQ ID NO: 10877 - protein, 1192 aa, Lycopersicon esculentum
MSHKRCHEYFSLNGVLKNVVFMIILLSSSFLVVVSNARKLAENDQVGRLLAFKKSSVESDPNGFLNEWTLSSSSPCTWNGISCSNGQVVELNLSSVGLSGLLHLTDLMALPTLLRVNFSGNHFYGNLSSIASSCSFEFLDLSANNFSEVLVLEPLLKSCDNIKYLNVSGNSIKGVVLKFGPSLLQLDLSSNTISDFGILSYALSNCQNLNLLNFSSNKIAGKLKSSISSCKSLSVLDLSRNNLTGELNDLDLGTCQNLTVLNLSFNNLTSVEFPPSLANCQSLNTLNIAHNSIRMEIPVELLVKLKSLKRLVLAHNQFFDKIPSELGQSCSTLEELDLSGNRLTGELPSTFKLCSSLFSLNLGNNELSGDFLNTVISSLTNLRYLYLPFNNITGYVPKSLVNCTKLQVLDLSSNAFIGNVPSEFCFAASGFPLETMLLASNYLTGTVPKQLGHCRNLRKIDLSFNNLVGSIPLEIWNLPNLSELVMWANNLTGEIPEGICINGGNLQTLILNNNFISGTLPQSISKCTNLVWVSLSSNRLSGEIPQGIGNLANLAILQLGNNSLTGPIPRGLGSCRNLIWLDLNSNALTGSIPLELADQAGHVNPGMASGKQFAFVRNEGGTECRGAGGLVEFEGIREERLAILPMVHFCPSTRIYSGRTMYTFTSNGSMIYLDLSYNSLSGTIPDNLGSLSFLQVLNLGHNNFTGTIPFNFGGLKIVGVLDLSHNSLQGFIPPSLGGLSFLSDLDVSNNNLSGTIPSGGQLTTFPASRYENNSGLCGVPLPPCGSGNGHHSSSIYHHGNKKPTTIGMVVGIMVSFICIILLVIALYKIKKTQNEEEKRDKYIDSLPTSGSSSWKLSTVPEPLSINVATFEKPLRKLTFGHLLEATNGFSSESMIGSGGFGEVYKAQLRDGSTVAIKKLVHVTGQGDREFMAEMETIGKIKHRNLVPLLGYCKIGEERLLVYEYMKWGSLESVLHDGGKGGMFLDWPARKKIAIGSARGLAFLHHSCIPHIIHRDMKSSNVLLDENFEARVSDFGMARLVNALDTHLSVSTLAGTPGYVPPEYYQSFRCTAKGDVYSYGVILLELLSGKRPIDPRVFGDDNNLVGWAKQLHNDKQSHEILDPELITNLSGDAELYHYLKVAFECLDEKSYKRPTMIQVMTKFKEVQTDSESDILDGISVKGSILEESQEREP

SEQ ID NO: 10878 - protein, 150 aa, Brassica oleracea
SRASGQGLEELMNEVVVISKLQHRNLVRVLGCCIEGEERLLVYEYMPNKSLDAYLFDPTKQKILDWKTRFNIMEGISRGVLYLHRDSRLRIIHRDLKASNILLDDNLNPKISDFGLARVFEANEDAAETRRVVGTYGYMSPEYAMEGYFS

SEQ ID NO: 10879 - protein, 149 aa, Brassica oleracea
SRASGQGLEELMNEVVVISKLQHRNLVRVLGCCIEGEERLLVYEYMPNKSLDAYQFDPTKQKILDWKTRFNIMEGISRGLLYLHRDSRLRIIHIDLKASNILLDDNLIQVSDFGLARVFEENEDAAETRRVVGTYGYMSPEYAMEGYFS

SEQ ID NO: 10880 - protein, 463 aa, Streptococcus pyogenes M1 GAS
MTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 10881 - protein, 338 aa, Streptococcus pyogenes M1 GAS
MKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 10882 - protein, 212 aa, Streptococcus pyogenes M1 GAS
MNLLIMGLPGAGKGTQAAKIVEEFGIAHISTGDMFRAAMANQTEMGRLAKSYIDKGELVPDEVTNGIVKERLAEDDIAEKGFLLDGYPRTIEQAHALDATLEELGLRLDGVINIKVDPSCLVERLSGRIINRKTGETFHKVFNPPVDYKEEDYYQREDDKPETVKRRLDVNMAQGEPILEHYRKLGLVTDIEGNQEITDVFADVEKALLELK

SEQ ID NO: 10883 - protein, 219 aa, Streptococcus pyogenes M1 GAS
MKENKRIAIAEAISHIKDGDTIMVGGFMANGTPEALIDALVDKGTKDLTLICNDAGFVDRGVGKMVANHQFKTIYATHIGLNKEAGRQMTAGETTIELIPQGTFAEKIRIGAYGIGGFYTPTGVGTLVAEGKETKTIKGKTYLLEYPFEADVALIFANQADEMGNLQYSGSENNFNQLMAACAKTTIVQAREIVPVGTIQPECVHTPHIFVDYIVKEGV

SEQ ID NO: 10884 - protein, 116 aa, Avena fatua
SQVYQKYKDQGLEILAFPCNQFGGQEPGTNEEIVEFACTRFKAEYPIFDKVDVNGKEVSPLYKFLKSSKGGLFGDSIKWNFSKFLVDKEGRVVDRYAPTTSPLSIEKDIKKLLGTS

SEQ ID NO: 10885 - protein, 449 aa, Streptococcus pyogenes M1 GAS
MSHITFDYSKVLESFAGQHEIDFLQGQVTEADKLLREGTGPGSDFLGWLDLPENYDKDEFARILTAAEKIKADSEVLVVIGIGGSYLGAKAAIDFLNHHFANLQTAKERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVIRVDNPRKNVIIPELAEDLDGLGYLQGKDVDFVNKKATDGVLLAHTDGGVPNMFVTLPAQDEFTLGYTIYFFELAIAVSGYMNAVNPFDQPGVEAYKRNMFALLGKPGFEALSAELNARL

SEQ ID NO: 10886 - protein, 453 aa, Streptococcus pyogenes M1 GAS
MAKKKATFICQECGYQSPKYLGRCPNCSAWSSFVEEVEVKEVKNARVSLAGEKSRPVKLKDVDNISYHRTQTDMSEFNRVLGGGVVPGSLILIGGDPGIGKSTLLLQVSTQLANKGTVLYVSGEESAEQIKLRSERLGDIDNEFYLYAETNMQAIRTEIENIKPDFLIIDSIQTIMSPDITGVQGSVSQVREVTAELMQLAKTNNIATFIVGHVTKEGTLAGPRMLEHMVDTVLYFEGERHHTFRILRAVKNRFGSTNEIGIFEMQSGGLVEVLNPSQVFLEERLDGATGSAVVVTMEGSRPILAEVQSLVTPTVFGNARRTTTGLDFNRVSLIMAVLEKRCGLLLQNQDAYLKSAGGVKLDEPAIDLAVAVAIASSYKEKPTSPQEAFLGEIGLTGEIRRVTRIEQRINEAAKLGFTKVYAPKNALQGIDIPQGIEVVGVTTVGQVLNAVFS

SEQ ID NO: 10887 - protein, 246 aa, Streptococcus pyogenes M1 GAS
MSNSIIEIKNLKKSYGSNEVLKDISLSVNKGEVISIIGSSGSGKSTLLRSINLLEEPSAGQILFHGEDVLAEHYNLTHYREKLGMVFQSFNLFENLNVLENAIVAQTTVLKRDRAQAEQIAKENLNAVGMTEQYWQAKPKQLSGGQKQRVAIARALSVNPEAMLFDEPTSALDPEMVGEVLKTMQDLAKSGLTMIIVTHEMEFARDVSDRIIFMDKGLITEEGSPQQIFENPTQDRTKEFLQRFLK

SEQ ID NO: 10888 - protein, 474 aa, Streptococcus pyogenes M1 GAS
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTSWGCIDCVSMSTAQLSKRYGFIYVDRNDDGTGQLTRYKKKSFDWYRQVIQTNGRYLEDNFS

SEQ ID NO: 10889 - protein, 159 aa, Streptococcus pyogenes M1 GAS
MPNLYDFTVKAQDGSDISLVDYKEKVVLVVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLG

SEQ ID NO: 10890 - protein, 451 aa, Zea mays
TANVLGHPTPSLRDHYALGRKLGQGQFGTTYLCTDLATGGLRCKSIAKRNVITKEDVEDVRREIQIMHHLAGHRNVVAIKGAYEDQLYVHIVMEFCAGGELFDRIIQRGHYSERKAAELTRIIVGVVEACHSLGVMHRDLKPENFLLSNKDDDMSLKAIDFGLSVFFKPGQIFTDVVGSPYYVAPEVLRKRYGPEADVWTAGVILYILLCGVPPFWAETQQGLFDAVLKGVIDFDLDPWPVISESAKDLIRRMLNPIPSRRLTAHEVLCHPWICDHGVAPDRPLDPAVLSRIKQFSAVNKLKKMMALQVIAESLSEEEIAGPKEMFMAMDTDNSGAITYDELKEGLRKYGSTLKDTEIRDLMEAADIDNSGTIDYIEFIAATLHLNKLEREEHLVAAFSYFDKDSSGYITVDELQQACKEHNMPAAFLDDVIKEADQDNDGRIDYGEFAEF

SEQ ID NO: 10891 - protein, 450 aa, Streptococcus pyogenes M1 GAS
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEGFSLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 10892 - protein, 379 aa, Schizosaccharomyces pombe
MVADTKLYDCLEVRPEASEAELKKAYRKLALKYHPDKNPNGEKKFKEISLAYEVLSDPQRRKLYDQYGITEGNAAPPPPGAEGGPGAGFGCFPGAGPGGARTFHFNMGGPGGAQFFSASDPNDIFERVFGHAFAGGGGMGGGMGGMGGMDDDMDMDGGFGTRTRGGGMPGGFANMFGGGGAGPHARRSHPSFGGSRPSQPPAQNEVITRPLNVSLEDLFTGCTKKMKISRHIIDASGQSVKADRILEIKVKPGWKAGTKIKFAGEGDEKPDGTVQDIQFVLAEKPHPVFTRSGDDLRMQVELSLKEALLGFSKQISTIDGKKLKVSSSLPTQPGYEITYPGFGMPLPKNPSQRGNMIIECKVKFPTELTPAQKTAAEAF

SEQ ID NO: 10893 - protein, 242 aa, Streptococcus pyogenes M1 GAS
MIRFNNVSKTFGQTKVLQEQTFQINDREFFVLVGPSGSGKTTLLKMINCLIEPSSGDILLNNVPQTELDLREMRLSIGYVLQQIALFPNLTVAENIAIIPEMKQWSAEEIRQKTEELLDKVGLPAKDYLDRYPSDLSGGEQQRIGIVRAIISHPKILLMDEPFSALDPISRKQLQELMLSLHKEFDMTIVFVTHDIDEAIKLGDRVAILNEGEIVQLDRPEMIKTHPANAFVVNLFGGDEHA

SEQ ID NO: 10894 - protein, 327 aa, Streptococcus pyogenes M1 GAS
MFNDIPVFDYEDIQLIPNKCIITSRSQADTSVTLGKYQFKLPVIPANMQTIIDETIAEQLAKEGYFYIMHRFDEDSRKPFIKRMHEQGLIASISVGVKACEYEFVTSLKEDAPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHFESPGKTVEVDGETFKEYYGSASEYQKGEHKNVEGKKILLPTKGHLSDTLTEMQQDLQSSISYAGGKDLDSLRHVDYVIVKNSIWNGDSI

SEQ ID NO: 10895 - protein, 456 aa, Streptococcus pyogenes M1 GAS
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDVSMGIHMFSLAIQEGVTIEKLALTDIFFLPHFNKPYNYITMAALGAKD

SEQ ID NO: 10896 - protein, 330 aa, Streptococcus pyogenes M1 GAS
MKLKLYNVRGEEAVLAKKWADDNGIEISLTESPLTPETVKEAEGFDGIANAQIGPLDDAIYPLLKEMGIKQIAQHSASVDMYNLDLATENDIIITNVPSYSPESIAEFTVTIVLNLIRHVELIRENVKKQNFTWGLPIRGRVLGDMTVAIIGTGRIGLATAKIFKGFGCKVVGYDIYQSDAAKAVLDYKESVEEAIKDADLVSLHMPPTAENTHLFNSDLFKSFKKGAILMNMARGAVIETQDLLDALDAGLLSGAGIDTYEFEGPYIPKNFEGQEITDSLFKALINHPKVIYTPHAAYYTDEAVKNLVEGALNATVEIIKTGTTTTRVN

SEQ ID NO: 10897 - protein, 466 aa, Streptococcus pyogenes M1 GAS
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSNAPEDVKAARIAELFQTKSFLDPSVLGVYPAELVSILEEADLLPQYSADELEIIKNNTVDFLGVNYYQPLRVQAPSKSQQEGDLLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 10898 - protein, 406 aa, Streptococcus pyogenes M1 GAS
MSTLSLDTTNKRALVAAIAASGTDDLNVMFLAFSMSSIMTDLGLSGTQGGWIATITNLGMLVGGLLFGLLADRHHKFKVFKWTILLFSVATGLIYFTQSLPYLYLMRFIAGIGVGGEYGVAIAIMAGIVPPEKMGRMSSLNGIAGQLGSISSALLAGWLAPSLGWRGLFLFGLLPILLVIWMTLAIDDQKIWDHYGQEEEECSQPIKINELFKTKSLTAQTLALMVMTTVQIAGYFGMMNWLPTIIQTSLNLSVKSSSLWMVATIVGMCLGMLYFGQLLDCFGPRLIYSLFLLASSICVYLFQFANSMASMVIGGAIVGFFVNGMFAGYGAMITRLYPHHIRSTANNVILNVGRALGGFSSVAIGSILDASGISMVMIFLASLYVISFGAMWSIGQLKAERYQQLR

SEQ ID NO: 10899 - protein, 475 aa, Streptococcus pyogenes M1 GAS
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 10900 - protein, 231 aa, Streptococcus pyogenes M1 GAS
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 10901 - protein, 244 aa, Streptococcus pyogenes M1 GAS
MTEAIISIKDLHKYYGHNEVLKGIDLDIMPGEVVVIIGPSGSGKSTLLRTMNLLEVPTKGQIRFEGIDITDKKNDIFSMREKMGMVFQQFNLFPNMTILENITLSPIKTKGMAKAEADKTALSLLDKVGLSEKAKAYPASLSGGQQQRIAIARGLAMDPDVLLFDEPTSALDPEMVGEVLAVMQDLAKSGMTMVIVTHEMGFAKEVADRVMFMDGGVIVEEGSPNQLFDLTKEERTKDFLSRVL

SEQ ID NO: 10902 - protein, 480 aa, Streptococcus pyogenes M1 GAS
MLAFPKEFWWGGATSGPQSEGRFAKQHRNLFDYWYEEEPDLFYDYVGPDTASDAYHQIESDLTLLASLGHNSYRTSIQWTRLIDDFEQATINPDGLAYYNRVIDACLANGIRPVINLHHFDLPIALYQAYGGWESKHVVDLFVAFSKVCFEQFGDRVKDWFVHNEPMVVVEGSYLMQFHYPAIVDGKKAVQVAYNLALATAKVIQAYRRGPAELSDGRIGTILNLTPAYPASQSEADMAAAHFAELWNNDLFMEAAVHGKFPEELVAVLKKDGVLWQSTPEELALIAENRVDYLGLNFYHPKRVKAPDAIPVISPSWSPEWYYDPYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 10903 - protein, 313 aa, Streptococcus pyogenes M1 GAS
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 10904 - protein, 216 aa, Streptococcus pyogenes M1 GAS
MCKEITIKEAVAHVKDGDTIMVGGFMTNGTPEKLIDALVEKGVKDLTLICNDAGFPDKGVGKMVANKQFSTIIASHIGLNREAGRQMTEGETVIDLVPQGTLAERIRSGGFGLGGFLTPTGIGTEVAKGKEVITIDGKDYLLEKPLKADVALIFANKADKNGNLQYAGSENNFNHVMAANAKTTIVEAREIVDVGQMDPNFVHTPGIFVNYLVKGA

SEQ ID NO: 10905 - protein, 484 aa, Streptococcus pyogenes M1 GAS
MYKDDSLTLHTDLYQINMMQVYFEQGIHNRHAVFEVYFRKEPFNNGYAVFAGLQRMVEYLEQFQFSETDLAYLEELGYPENFLTYLKELRLELTIRSAKEGDLVFANEPIVQVEGPLGQCQLVETALLNIVNFQTLIATKAARIRSVIEDEPLLEFGTRRAQELDAAIWGTRAAMIGGADATSNVRAGKRFDIPVSGTHAHALVQAYGNDYDAFMAYAKTHKDCVFLVDTYDTLKVGVPTAIRVAKEMGDKINFLGVRLDSGDLAYLSKTVRQQLDDAGFTEAKIYASNDLDENTILNLKMQKAKIDVWGVGTKLITAYDQPALGAVYKIVSIEQEDGSMRDTIKLSNNAEKVSTPGKKQVWRITSREKGKSEGDYITFTDINVNELTEIEMFHPTYTYIKKTVKEFDAIPLLVDIFVKGELVYQLPTLAEIKAYAKKEFDKLWDEYKRVLNPQDYPVDLARDVWQNKMALIDNIRKDAYGKSE

SEQ ID NO: 10906 - protein, 459 aa, Streptococcus pyogenes M1 GAS
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIIFGIYSNVKFK

SEQ ID NO: 10907 - protein, 486 aa, Streptococcus pyogenes M1 GAS
MEKFFKLSENGTTVSTEIMAGLTTFFAMSYILFVNPSILGAAGMPSNAVFLATIIAAAISTLIMGLFANVPYALAPGMGLNAFFTYTVVFALRFSWQEALAMVFICGLFNIFITVTKFRKSIIKAIPVSLQHAIGGGIGVFVAYLGFKNANIITFSISAENIVMVNGVEPAKASAKTFADGLLFVDANGGVVPTISSFTDSGVLLAIFGLLLTTALVIRNFRGAILIGIVATTLVGIPLGIVDVSNLNFGISHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRTGLTAVSTAVCFLLSILLLPLVGIVPAAATAPALIIVGVMMVSSFLDVNWSKFADALPAFFAAFFMALCYSISYGIAAAFIFYCLVKVVEGKTKDIHPIIWGATFLFIVNFIILTIL

SEQ ID NO: 10908 - protein, 288 aa, Streptococcus pyogenes M1 GAS
MALFRKKDKYIRITPNNSLKGSVSHNVPEVPDELFAKCPACKHMIYKKDLGLAKICPTCSYNFRISAQERLTLTVDEGSFQELFTSIETKDPLRFPGYQEKLQKAKETTGLHEAVLTGKAMVKEQKIALAIMDSHFIMASMGTVVGEKITRLFELAIEENLPVVIFTASGGARMQEGIMSLMQMAKVSAAVKRHSNAGLFYLTILTDPTTGGVTASFAMEGDIILAEPQSLVGFAGRRVIETTVRENLPDDFQKAEFLQDHGFVDAIVKRTELRDKIAHLVAFHGGGQ

SEQ ID NO: 10909 - protein, 468 aa, Streptococcus pyogenes M1 GAS
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDGGRIDYVKKHLEVISDAISDGANVKGYFMWSLMDVFSWSNGYEKRYGLFYVDFETQERYPKKSAYWYKKVAETQVIE

SEQ ID NO: 10910 - protein, 1165 aa, Streptococcus pyogenes M1 GAS
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 10911 - protein, 328 aa, Streptococcus pyogenes M1 GAS
MLEDYYPSTTSYYHGGIDDDLYTAKWGMVMTFLDLNDSSLTPFEGTHFALIGFKSDKGVYINNGRVGAVESPAAIRTQLAKFPWHLGNQVMVYDVGNIDGPNRSLEQLQNSLSKAIKRMCDLNLKPIVLGGGHETAYGHYLGLRQSLSPSDDLAVINMDAHFDLRPYDQTGPNSGTGFRQMFDDAVADKRLFKYFVLGIQEHNNNLFLFDFVAKSKGIQFLTGQDIYQMGHQKVCRAIDRFLEGQERVYLTIDMDCFSVGAAPGVSAIQSLGVDPNLAVLVLQHIAASGKLVGFDVVEVSPPHDIDNHTANLAATFIFYLVQIMAQHS

SEQ ID NO: 10912 - protein, 1547 aa, Aspergillus fumigatus
MADGSRLPESATSTTMETNTNEHAKVLSPDAETVPSSSVTATSSELSLDGRWGERDQGEPVSRRGAMEDFEEMRRELTQLSLRRTRSVGKDAHRLRSRASGRASQVHDEEKAIDEEDSTIDGDGDGYQGGFDLGEFLMGGHLERRTTTGEPAKKVGVLFKHLTVKGVETGASFVRTLPDAVVGTFGPDLYRIVCSFIPQLRFGKQPPVRELLHDFTGLVREGEMMLVLGRPGAGCSTFLKTIANDRGAFAGVEGEVRYGGLSAEEQLKHFRGEVNYNPEDDQHFPSLTVWQTLKFSLINKTKKHDKNSIPIIIDALLKMFGITHTKNTLVGNEYVRGVSGGERKRVSIAETLATKSSVVCWDNSTRGLDASTALDYAKSLRIMTDVSKRTTFVTLYQAGESIYELMDKVLVIDSGRMLYQGPANKAREYFVNLGFHCPEKSTTADFLTSICDPNARQFQPGREASTPKTPEELEAVFRNSETYKTICDEVASYEKKLQDTDQEDTRRFQKTVAQSKSRTVSKKSSYTVSFARQVLACVQREFWLLWGDKTSLYTKYFIIISNALIVSSLFYGESLDTSGAFSRGGALFFSILFLGWLQLTELMPAVTGRGIVARHKEYAFYRPSAVSIARVVMDFPAIFCMVVPFTIIMYFMTGLDVTASKFFIYFLFVYTTTFSITSLYRMFAALSPTIDDAVRFSGIALNILVIFVGYVIPKQGLIDGSIWFGWLFYVNPIAYSYEAVLTNEFSDRIMDCAPSQLVPQGPGVDPRYQGCALPGSELGRRGVSGSRYLEESFQFTRSHLWRNFGVVIAFTVLYLIVTVLAAEFLSFVGGGGGALVFKRSKRAKKLATQTTQGNDEEKVQDVGDKAALSRGEAMSASNGESFKRISSSDRIFTWSNVEYTVPYGNGTRKLLNGVNGYAKPGVMIALMGASGAGKTTLLNTLAQRQKMGVVTGDFLVDGRPLGADFQRGTGFCEQMDLHDNTSTIREALEFSALLRQDRNVSKQEKLDYVDQIIDLLELNDIQDAIIGSLNVEQKKRVTIGVELAAKPSLLLFLDEPTSGLDSQAAFSIVRFLKKLSLAGQAILCTIHQPSSMLIQQFDMILALNPGGNTFYFGPVGHDGGDVIKYFADRGVVCPPSKNVAEFILETAAKATTTKDGKKIDWNEEWRNSEQNQRVLDEIQQIREERSKIPVTETGSHYEFAASTMTQTLLLTKRIFRQYWRDPSYYYGKLFVSVIIGIFNGFTFWMLGNSIANMQDRMFSIFLIIMIPPVVLNSIVPKFYINRALWEAREYPSRIYGWFAFCTANIVCEIPMAIVSSLIYWLLWYYPVGFPTDSSTAGYVFLMSMLFFLFMSSWGQWICAFAPSFTVISNVLPFFFVMCNLFNGIVRPYRDYPVFWKYWMYYVNPVTWWLRGVISSIFPTVQIDCSPSETTHFNPPPGQTCANYAGNFITNIAKNGYLLNPDASADCQYCPYSNGAEYMATLNVHDGDKWRCFGIFLAFVIINWLLVYFFIYTVRVRGWSFGMGYLFGGMGLVIDKVKGVFKRKSEKA

SEQ ID NO: 10913 - protein, 1076 aa, Schizosaccharomyces pombe
MLENDLQKVVNLFNTRIVQLDNYVTRLSTEKSPNTEITQALSSSYEAEEKAKQLKELDFRLQQLSSFCEWNKLAFEKLAANMDKHLGTERLVTFYEQKVCKLDFANSSKIYESMIALKALNSSQNDSEVKDKLEKLSIHHPLKKDLLAFIQLDIAAEVVTACINAPDSVLVDILAASIIAGAKACMREVIGRIGLRSECLASALRRAINNLCGPDEGVLYFLEVLKQICSVVYVDSYHSNRLLSRILLVERNSKGQSVMHSVAKLGWAGLCSKFCEIVSSIPDSEPLNWMLPCWRDVMHDTPLTLAIKGNHVEALHALLSAQDKETTSTKPGPVPPLVLTCCVGDYDLIVEELILAGFNPNEVDASSNTALHTAVRYNRPECVKMLLKLGANPSARDFLNSWTPLMLASATGLSEIVSILVASGASVDEVDSSGWTAMEQAVVRGYLHLADKLRTQVALSDKPVNLHTLYIKASSSEMRSRKRAMDLQLSRSVVIIRISDLAGRIRVSLQGDDAVYVSGRSPSFAASRPSSVDFMSQSTDSLSKNDTTASNGSMTPSSSQNNSVIIDIPRSHFDNAGEVCLENLAEPDEIADDSIHLHYDAAQENSPQPVNGSSPPYELVFVTRNTEEATITIDLLANRSHKILGRTVCCLTSLVSDLGNHMQSLKPLAPLPLLSSKTLKPIAHVNADVLISKVTVDDRFSSNDGISTPALSLEAVSNVSRTALEDAERSLHKSATTTSESGKSNGVAVIGHRGLGKNQPDRLSLQLGENTLQSFIKAADLGASYVELDVQMTKDMVPVVYHDFIVNETGTDAQVHSLTLEQFLGASHSPSEEIKDDASDIQQKRRPRAYSSSFTPSGSQVNFGEFAEENARLKPKVYKGNALGHTICAPFTTLKDVLKEVPQSVGLNVEFKYPMLSEAEEEKLLPIAYDYNFYVDTILSIIKKYGGKRKYIFSSFNPDICILLSLKSTNPVLFLTEGGTAYRTDVRAASLRQALKFASQWSFLGIVSACEPLIMCPRLIKAVKQLGLSCYTYGVLNNDVDNVRRQVRFGVDAVIVDNVLAIRRALNQYDESLESD

SEQ ID NO: 10914 - protein, 2111 aa, Schizosaccharomyces pombe
MAVLSSVQPINHNSALVEARDEQVNTTACSDDLLNAPPYEYDTEGNPSWAGALPKAQALYDPAYEKDSCGVGFTCHIKGQVSHKIVTDARLLLCNMTHRGATGADTRDGDGAGVMTGMPYTFMQKEFGQIGCTLPKSGEYAIGNVFFSPEADVCREAMTAFTQVAEKLGLAILAWRSVPCDNSILGPAALSREPTILQPCVVLKAAYDGEAEFDTDLFERQLYVLRKQSSHLIGKEKWFYICSLHRETIVYKGQLAPVQVYNYFLDLNNAEYVSHFALVHSRFSTNTFPSWDRAQPMRLAAHNGEINTLRGNKNWMHAREGLMKSSRFGEEFASLLPIIERGGSDSAAFDNVIELLCASGVVSLPEAVMLLIPEAWQNDKNISDEKAAFYEWAACQMEPWDGPALFTFADGRYCGANLDRNGLRPCRFYLTSDDMMICASEVGTVGIEPDRIVQKGRLYPGRMLLVDTKEGRIVDDKELKHNIASRYDFRSWLDQELIDMNSIVDSLIESTSVDLTPIVDDVPLADDKTMLAFGYTLEQINMIMAPMANGGKETLGSMGNDAAIACLSDQPRLLYDYFRQLFAQVTNPPIDPIREAIVMSLQCYIGPSGNLLEINQSQCRRLRMPTPILTVEEFNALKNVDRIYPDWKVASIDITFFKSEGVAGYAAAIERICSEADTAVNEGYKAIVLSDRNVNSERVPLASIAACGAVHHYLVQNKLRSRVALVCESGDAREVHHMCTLLGYGADAVCPYLAMEALTKLVRQNAMKPGITEETAIKNFKHAINGGILKVMSKMGISTLQSYKGAQIFEALGIDNEVINKCFLGTASRIRGVTFEHIALDAFALHERGYPTDQSIRSLQIPDMGDFYYRDGGEQHVNHPKAIASLQDAVRNKNEAAYAEFSRTHYEQTRRCTLRGMLDFDFDSSQAIPIEQVEPWTEIVRRFCTGAMSYGSISMESHSSLAIAMNRLGGKSNTGEGGEDPARSQRLANGDTMRSAIKQIASGRFGVTSWYLSDADELQIKMAQGAKPGEGGELPGNKVSESIAKTRHSTAGVGLISPPPHHDIYSIEDLKQLIYDMKSANPRARVSVKLVSEVGVGIVASGVAKAKADHILVSGHDGGTGASRWTGIKYAGLPWELGVAETHQTLVLNDLRGRVVIQTDGQIRTGRDVAIACLLGAEEWGFATTPLIALGCIMMRKCHLNTCPVGIATQDPELRKKFEGQPEHVVNFFYYVAEELRGIMAKLGFRTINEMVGRSDKLKVAEPINNKSKLLDLTPLLTPAFTLRPGAATYNVRKQDHRLYTRLDNKLIDEAEVTLEEGIPSVVECEIINTDRTLGATLSNKISKRYGEEGLPTDSIRVNVFGSAGQSFGAFLAPGVTLQLEGDCNDYVGKGLSGGRLIIYPPRVSPFKPEENMIIGNVCLYGATSGHAFISGVAAERFAVRNSGAIAVVEGVGDHGCEYMTGGRVVILGSTGRNFAAGMSGGIAYVYDMQMDFAGKINTEMVDISSVTDAAEIAFLRGLIQDHRHYTGSQVADRILSDFPRHLSRFVKVLPREYKAVLEREAAKKEEAKRLQYPKAFMPGNPIRQQIEETNAQIADVEDTLGATVKKSAPLDKLRGFMKYQRRSEHYRNPLKRTNDWKELSVRLREDELRVQTARCMDCGTPFCQSDYGCPISNKIFTWNDLVFKQQWKEALTQLLLTNNFPEFTGRVCPAPCEGACTLGIIESPVGIKSVERAIIDKAWEEGWIVPRPPAERTGRRVAIIGSGPAGLAAADQLNRAGHHVVIYERADRPGGLLQYGIPNMKLDKKVVERRIQLMIDEGIEVLTNVEVGKNGDVSLDELHKVYDAVVLASGSTVPRDLPIPNRDSKGIHFAMEFLHKNTKSLLDSELKDGNYISAKGKDVIVIGGGDTGNDCLGTSVRHGAKSVRNLELLPIPPRERAFDNPWPQYPRVFRVDYGHAEVQAHYGQDFREYSILTKSFEKDEDGNVKGINTVRIEWTKNSKGRWIMKEIRNSEEFFPADLVILALGFLGPEEQATAGMNVDRDARSNISTPTKSYETSVPGIYAAGDCRRGQSLVVWGIQEGRQCAREIDLKFQGKTFLPGDGGLVKRTVNC

SEQ ID NO: 10915 - protein, 385 aa, Schizosaccharomyces pombe
MGLGFQEKNPVFVKEKQSPFYAVPSNYEEVEFSSIVEPMYSGIATFGRLENVECLSKRSEDFDIAFIGMPFDTGTSYRPGARFGPSSLREGSRRINTKYGAVNVPLEINPFKSWAKLVDCGDIPVTTYDILKAMDQLESAYFQLIARKPSSFTDHDGFAKNDTVLPRVLSLGGDHTIVLPILRALHRVYGQPISVIHFDSHLDTWAPGLIGDGDEADGINHGSYFYFASQEGIMSKDANIHAGIRTPISSFSDYDDDVDCGFKIIEAREIDDLGIDGIVKKIRDRVGDNLVYLSIDIDVLDPAFAPATGTPETGGWSSREMRAILRGLQGLKFVGADLVEVAPAYDVAEITSLAGAQLLFDIVSMMVKYPLVKEADLSRYMPIHK

SEQ ID NO: 10916 - protein, 1396 aa, Schizosaccharomyces pombe
MSEQEKGKGDLDDPNSKNTKCPDKFEQKVEEYLEVLNELHLTGRTSGFCMRNFTVEGAFNPKFQIRSFFAQLLHPINIIFRTGPKRDIIPLVKGFDGYLQPGSSLLVLGHEGSGGSTLLKALCGIVEENERLNGSLHYDGLDYKIAHSQFKADLSYCGEGHSKVATITVRRLLEFVCSCRLPASKYDHPRSHYIRRICEIIRDAFDLGDFYNHRILRVFNSGDQIKVDVAQTMCARPLIQCWDNNMRDFDSISVIDILSRIKVLSHKLGTTLVAIVSQASDRIFHMFDMVTLMYEGEQIFYGPTSRLKPYFLDLGFIPAKHSTTVEFVTSLTYPEMRIINKKHQGFIPSTPAEFRECWLRSEDYAKLIKFMDRYEENHSDIHAFKDAKFDQTRLQKFLRWLNSNPCLIPYRLQVFATAKVTFFQYLHDYSYIATFVFTYVFQALMLGSLFYNLRNESSELYSRGSVLSNAIVFTAIQTMSEVDIIFLKKSLFKEHRVQSLYHPSAALMGSSLVEFPMRIVVVTMYDIIVYFLSDLKRNARSFFIFYLFTIVITFCMSAVFRFIALLSTTAEIAALIGGIGALVLIIFCGAVMPVQYIGWWFRWIAYANPVNYGYESIMLNEFDGREIPCSLMAPAPDTAPIENNFCLATAGRTGTSIVSGYQYLQVVYQYKADFLWRNCGIILGFAIFILASSLILANFIRYDRESVHIPEFQKRKSYSQVASSFLIEPQDKPPSQTEPDNKKVDVSTTLSTNDNLVLCWRDLNFTVVTKTSKKQILTNVSGYLKKNTLTALLGENKSGKSVLLRILSQRGIAGSVEGEITLSGLKNPKNLRKRIGYVRKNPLFISEYTVRETLRLHAALRQSKQRSLSEQYAYVEYVIDFLGLGEVADFIVGDMGKGLSLYHKRLLSIAVELSARPGSILLLDEPANGLDSQSAWMLVCILQKLARSGLSILCSVSQPSSRILELFDMMLILDLNGNTVYYDTMGRDLSKLVNYFKRIHGTNEHSKDTADFVLHCIQFLKQGPEFDYAGAWASTNTHKQIIEHVNFIMDNPELTDDDFPNETRFMTSFFFQIYKISMRNFVAYWRDSSLLRARVAFNIVAGLIIGFSFYKQGVGVEETQNKMFSAYMLTVASTSTMNGLQPKFIYFRSIYEQYEQNTAIYSRTAFIIAFFLVEAVINCCFATLFFFGWYYPSGFYEFNHNIPFYGGFAWLMLMIFTLYYTTLGIGIATISPSIGTASIISGTAFVFIQYFNGMIQLPGVIVGFWKWMDALSPYKYFLEGMIGGVLHDAPITCEKFEIHYVDPPPNYSCGEYFSSFLNSSGHGIVYNPEAYSSCQYCPYKNADELMVGFGYHYNHKWRNFCIMIGYTAFNLGAAIALYYIIHKTPWKRLAARFVPD

SEQ ID NO: 10917 - protein, 505 aa, Schizosaccharomyces pombe
MDASVSLLPEGESLHRSLSASQIQMLAFGGIIGTGLFLGIGSSLAESGPASLLISFSVLGVSVYCTMLALGEMSVYMPVAGSFCTYVGRYVDEALSFSLTWNYWLNDTIALASHVLATRLVVDFWLIPTEGDPVSASLSLPPWKEAVRIITPITSLSANIILNMLPVGGFGEIEYWLSSIKVFTVAAFIVNGILCNLGVNNEKKFIGFRYWKDPGAFNNGIIGVISSFVNAAFAYAGTESIALTAGEAKSPITTLPKAIRFTAHRVLLLYIISVLVVGINLPYNTPGLDGDSVRMSPFTFVFKKFGVPGAASIMNLVILSSALSAGNHSLYAGTRLLYSLAKSGHAPKVFSKCNKHGIPWLSVLATSATAILCLMSSQAGKTWGFLLNVIAVSNQISWIFIAVSSLRFRKALRVQGKTHRLYFPNWTYPVGPYIIILLNGVFLFLQGYKSLYPFRLSLFVSYYMEIPIVLGLYLIWKIYKKTKLVSSSEADLETDWKSLEDTDSA

SEQ ID NO: 10918 - protein, 269 aa, Geobacillus stearothermophilus
MLLLSVNPPLFIPFIVAGDPSPEVTVDLALALEEAGADLLELGVPYSDPLADGPTIQRAAARALAGNMTLPKAIHLVAEMRKKGVTIPIILFTYYNPVLQLGEESFFALARENGANGVLIPDLPFEESGPLRELGERFDLPLISLVAPTSKQRIERIASVAQGFLYCVSSLGVTGMRETLPESLGDFVSEVKRHSRVPVAVGFGISTPEQVAMLKEVCDGVVIGSALVQKVEQLGERLLAPEEKEAAIAEFAAYARSLAAPLHAPCSLR

SEQ ID NO: 10919 - protein, 208 aa, Podospora anserina
MAAAAVVQIPVGATFLKTFKKSFVDVPIDAEKGNAISTAEFLEAAESLTTMFDVLGSIAFTPVKTDMLGNVEKIRKRMLAAPLASQNIQDLVRNELKTKSHTATEGLLWLVRGLEFTCIALSKNINSTEELADSFRGSYSETLMRHHSFLVKRIFSAAMGACPYRKDFYAKLGDDEQKVQEELREYLAALDKIVYILKGFLESKEAKW

SEQ ID NO: 10920 - protein, 382 aa, Lolium perenne
MVQPVFDAALLSGQSDIPSQFIWPADESPSPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNGTLGTGPHCDPTSLTILHQDDVGGLQVHADGRWLSIRPRADAFVVNIGDTFMALSNGRYKSCLHRAVVNSRVPRKSLAFFLCPEMDKVVAPPGTSVDEANPRAYPDFTWRALLDFTQKHYRADMKTLEVFSDWIQQGHQPAATTTTTQDQRTYTASASLHLLACCT

SEQ ID NO: 10921 - protein, 363 aa, Lolium perenne
MVQPVFDAALLSGQSDIPSQFIWPADESPSPDATEELHVPLIDIGGLLSGDRVAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 10922 - protein, 363 aa, Lolium perenne
MVQPVFDAALLSGQSDIPSQFIWPADESPSPDATEELHVPLIDIGGLLSGDRAAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEAYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPETLVDEANPRAYPDFTWRALLDFTQKHYRADMKTLEVFSDWIQQGHQPAATTTTT

SEQ ID NO: 10923 - protein, 362 aa, Lolium perenne
MVQPVFDAALLSAQSDIPSQFIWPADESPTPDATEELHVPLIDIGGLLSGDREAAAEVTRLVGDACERHGFFQVVNHGIDAELLGHARCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 10924 - protein, 323 aa, Pantoea agglomerans
MKPEVLLYKSLPDDLRARLDEHFTVTAINGLSPETIAEHGGAGARRRHDRLQQHGGSSAAGENAKLRAASTISVGYDNFDVEALNQRGIVLIDTPTVLTETVADTMMALVLSSARRVVEVAERVKAGEWRRSIGPDWFGIDVHHKKMGILGMGRIGLALAQRAHHGFGMPILYNARKHHEEAESRFNAQYCDLDTLLRESDFLCISLPLTEQTHHMIGREQLAKMKPSAILINAGRGPVVDEQALIAALKDKTIHAAGLDVFEQEPLPVDSELLTLPNVVALPHIGSATHETRYGMARDAVDNLIAALAGKVEKNCVNPQVLR

SEQ ID NO: 10925 - protein, 347 aa, Mycobacterium leprae
MAAIGGDGRMPMGVAIEVKGLTKSFGSSRIWEDVTLDIPAGEVSVLLGPSGTGKSVFLKSLIGLLRPERGSILIDGTDIIECSAKELYEIRTLFGVLFQDGALFGSMNLYDNTAFPLREHTKKKESEIRDIVMEKLQLVGLGGDEKKFPGEISGGMRKRAGLARALVLDPQIILCDEPDSGLDPVRTAYLSQLIMDINAQIDATILIVTHNVNIARTVPDNMGMLFRKHLVMFGPREVLLTSDEPVVRQFLNGRRIGPIGMSEEKDESTMAEEAALLEAGHYAGGAEEVEGVPPQITVTPGMPKRKAVARRQARVRAMLPTLPKGAQAAILDDLEGAHNYQAHEFGD

SEQ ID NO: 10926 - protein, 280 aa, Oryza sativa
FPEISVGGAPPVWQGMKEQQLIEKDVFSFWLNRDPDAPTGGELIFGGVDPNHYKGSHTYVPVTRKGYWQFEMGDLLIDDYSTGFCSGGCAAIADSGTSLLGGPTTIVAQINHAIGAEGIVSMECKQVVRDYGDMILEMLIAQASPMKLCSQIGLGAFDGTRSVRNNIESVVDKEKVGSDLSCTACEMSVVWIQNQLRHNQTRELILQYADQLCERLPSPNGESGDDCDEISNMPNLSFTIPNKTFTLTPEQYVVKLEQQGQTVCISGFMAFDVPPPPGPL

SEQ ID NO: 10927 - protein, 194 aa, Colletotrichum trifolii
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLREDPSVREKLSKQKMSPVRKEDGERMAKDLGAVKYVECSALTQYKLKDVFDEAIVAALEPPAPKKKSHKCLVL

SEQ ID NO: 10928 - protein, 302 aa, Pseudomonas aeruginosa
MFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 10929 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 10930 - protein, 507 aa, Lolium rigidum
MNLEVAFLHEYASPRALVVAVVLVLVAVHLARSTSRAERLRRKLPCPRFTLPVIGHLHLIGSLPHVGLRDLARKHGPDVMLLRLGAVPTLIVSSPSAARAVLRTHDHVFASRPDTVVGDILFVGSTNVGHSPYGEYWRQVRKIITTHVLTAKKIRANLPYREQEARLALASVREAAAAGTAVDLTHLFSHFAHDMVSQAVAGRIHREDRWGKLFHDLFVGNGQLLGGFNLDDCFPSLARLGIGSANIAKQRKRWDDLLDEVIDRHTSTPMEKGDEPDFIDVMLSVQDEYKLTRNNIKSILMDMFQAGTDTTFIWLDYAMAELARAPQVMAKLQAEVRRCSTTNQLLTQEDLSSMSYLKAVMKETMRLHPPGPLLLPHASIADCEVEGYVVPAGTRVIINVWAIGRHASSWERAEEFVPERFLEGSVDANSDFYGNDFRLLPFGSGRRMCPGINFATLTFEIILANLIYHFDWELPEGSPGVDMTEAFGMDVHRKENLLLVPRVAKIV

SEQ ID NO: 10931 - protein, 510 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGPSTPVNLSVMFHSITNSIVARATFGKKRKNAAEFMAAIKSGVGLASGFNIPDLFPTLTTVLATITGMKRSLHGIHTSHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASGLRYLKLVIKEALRLHPPAPLLVPRESIDVCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 10932 - protein, 507 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGLSTPVNLSVMFHSITNSIVARATFGKKRKNAAEFMAAIKSGVGLASGFNIPDLFPTLTTVLATITGMKRSLHGIHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASELRYLKLVIKEALRLHPPAPLLVPRESIDMCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 10933 - protein, 506 aa, Lolium rigidum
MNDDLVYVCSALAVSILAIAVVQLLKARQRLPPGPLNLPVIGSAHRLVNALPHRAMRDLAGVHGPLMYLRVGQVPLVVVTSKEVAREVLKTHDAIFATRPKLMAGDIVAYGSTDLLFCSTPGDYFRKLRRLCVQEILSNDRIRSYQDIREDEVRSLVEDIRAAGPSAPVDLSRKIYKLTNGIVSRAAFGMKSSKAEDFVAAIKHSFVYSTGFSIADLFPGFTGILSFLTGQRRTLEGVRDTIDGILEEIINEREQILKSGRSTASEKNLVEVLLGLQGNEDFGFPITRSTVKAVILDIFAGGTETSGTSMEWAMSELMANPKVMGKLQGEIRAAFGDKEFISEADLRASGGVMKYLGLVIKETFRLHPPAPILVPRESTEACEINGYVIPAKTRVVINSWAIMRDPRYWEDAEEFRPERFEGGRMDFLGGNFEYTPFGSGRRMCPGYNYGMASMELTLVQLLHSFDWSLPDGVDQLDMTEIVSLSLTRKTHLMLRAAPHRAPLPSS

SEQ ID NO: 10934 - protein, 513 aa, Lolium rigidum
MVMEMEPSSATLFFLSVVTLVILVSLVSRKPSSKLRRPPGPRDLPFVGSLHHLLTSQPHVALRNLAKTHGPVMRLRLGQVEAVVVSSSAAAQEVLRDNDLSFASRPNLLATEIMCYGNLDVAFAPYGAYWRALKKLCVLELLSSRKVRQFKPVRDSETMSLIKEICAAGKGGKPVKLRSLLVKCTSSVTGKATFGERCDIDLREQFMAAMEVAQIHSSGFCVGDLFPSLGFLDVATGMRYQLWRARQQLDNVVDKIISDCEARREEKKSTPTGDEDLLSLMLRIRDEGGSDFPIETINIKAIIVDLFTAGTETTSSTAEFVMSELMRNPKVMKKAQEEVWRMMENKSPQDHENHMDELPYLRMVIKETMRLHPVVPLLLPRLCRESCHVGGFEITKGTRVIINAWALATSPENWNEPEEFRPERFEDSVVVNDKGTQFKLMPFGGGRRMCPGDGFALATLELMVARLLYYFEWSLPDGMRPDELDMDVKVGTTSRRRNELRVVASPCRIPIEI

SEQ ID NO: 10935 - protein, 498 aa, Lolium rigidum
PLFLLGSLALAVSLLVLLGHGRGKTRLPPGPPALLFLAKFVALRRSIFDLGPLIVDLHARHGPVISIHLFRTLIFVADRKMAHRALVQGGATFAERPPPVDPTRLFTSGGRDISSSPYGTYWRLLRRNLAAEALSPARVAHFAAARRSACDGLVSSLLREQERQGQEEAVTLRPFLRRAMFELLVFMCFGARLEREAMDEVEELQHQVLVAFTSFPVFAFFPAVTKRLFRRRWAEYLAVRRRHEEVFVPLIHAERAGGDPPCYAESLLAVRMADDVRLTDAEMVSLCSEFLNGGTDTTVTLLEWIMAELVNHPDVQAKVYEEVRANPELNDLQGMGMPYLKAVVMEGLRLHPPGHFLLPHGVQHSGDGGVEIGGYMVPKGAEVNFLVAEIGRDETVWTAAREFRPERFLEGAEGHGVDITGSREIKMMPFGAGRRMCPGYSLGMHHAEYFVARMVMDVEWRPPVEGEEVDMAETLDFTTVIKHPLRARLFARTNSHNA

SEQ ID NO: 10936 - protein, 484 aa, Rhodococcus erythropolis
MQALTSSVPLVIGDQLTPSSTGATFDSINPADGSHLASVAEATAADVARAVEAAKAAARTWQRMRPAQRTRLMFRYAALIEEHKTELAQLQSRDMGKPIRESLGIDLPIMIETLEYFAGLVTKIEGRTTPAPGRFLNYTLREPIGVVGAITPWNFPAVQAVWKIAPALAMGNAIVLKPAQLAPLVPVALGELALEAGLPPGLVNVLPGRGSVAGNALVQHPSVGKVTFTGSTEVGQQIGRMAADRLITASLELGGKSALVAFGDSSPKAVAAVVFQAMYSNQGETCTAPSRLLVERPIYDEVVELVQARVEAARVGDPLDPDTEIGPLISAEQRESVHSYVVSGTEEGATLISGGDQSPTGAPEQGFYYRPTLFSGVTADMRIAREEIFGPVLSVLPFEGEEEAITLANDTVFGLAAGVFTRDVGRALRFAQTLDAGNVWINSWGVLNPASPYRGFGQSGYGSDLGQAAIESFTKEKSIWARLD

SEQ ID NO: 10937 - protein, 358 aa, Rhodococcus erythropolis
MSTSIHIQTDEQAHLRTTARAFLARHAPALDVRIWDEAGKYPEHLFREIARLGWYDVVAGDEVVDGTAGLLITLCEEIGRASSDLVALFNLNLSGLRDIHRWGTPEQQETYGAPVLAGEARLSIAVSEPDVGSDAASVATRAEKVGDSWILNGQKTYCEGAGLTGAVMELVARVGGGGRKRDQLAIFLVPVDHPGVEVRRMPALGRNISGIYEVFLRDVALPATAVLGEPGEGWQILKERLVLERIMISSGFLGSVAAVLDLTVHYANEREQFGKALSSYQGVTLPLAEMFVRLDAAQCAVRRSADLFDAGLPCEVESTMAKFLSGQLYAEASALAMQIQGAYGYVRDHALPMHHSDG

SEQ ID NO: 10938 - protein, 488 aa, Actinomyces naeslundii
  misc_feature (148)..(148): Xaa can be any naturally occurring amino acid
  misc_feature (316)..(316): Xaa can be any naturally occurring amino acid
MTATSTTSKSNPNFPDGFLWGGATAANQIEGAYNEDGKGLSVQDVMPRGIMAHPTQAPTPDNLQARGDRPSTTAYAEDISLFAEMGFKVFRFSIAWSRIFPLGDETEPNEEGLAFYDRVLDELEKHGIEPLVTISHYETPLHLARTYXGWTDRRLIGFFERYARTLFERYGKRVKYWLTFNEINSVLHEPFLSGGVATPKDRPPEQDLYQAIQNELVASAAATRIAHETNPDIQVGCMILADPTYPLTPDPRDVWAAKQAERANYAFGDLHVRGEYPGYLRRTLRDKGIELEITEEDRVLLREHTVDFVSFSYYMXVCETVTQSAEAGRGNLMGGVPNPTLEASEWGWQIDPAGLRTILNDYWDRWGKPLFIVENGLGAKDVLVDGPNGPTVEDDYRIAYMNDHLVQVAEAIADGVEVLGYTSWGCIDLVSASTAQMSKRYGFIYVDRDDGGNGTLARYRKKSFGWYRDVIASNGASLVPPVQEPPRG

SEQ ID NO: 10939 - protein, 310 aa, Amaranthus tricolor
  misc_feature (197)..(197): Xaa can be any naturally occurring amino acid
NEYIDYVGSWGPAIIGHADDEVLAALAETMKKGTSFGAPCLLENNLAEMVISAVPSIEMVRFVNSGTEACMGVLRLARAFTGKQKIIKFEGCYHGHADPFLVTAGSGVATLGLPDSPGVPKSATSDTLTSPYNDLETIKGLFEANKGEIAAVILEPVVGNSGFIPPNPGFLEFLREITKENDTLLIFDEVMTGFRLXYGGAQEYFKITPDLTTLGKVIGGGLPVGAYGGRRDIMEMVAPAGPMYQAGTLSGNPLAMTAGIHTLKRLMQPGSYEYLDKITSELTQGIIAAGKKTGHAICGGYISGMFGFFF

SEQ ID NO: 10940 - protein, 225 aa, Amaranthus tricolor
KWHVIMACRDFLKAERAAKSAGMAKENYTIMHLDLASLDSVRQFVNNFRQSGRPLDVLVCNAAVYLPTAREPTYTAEGFELSVGTNHLGHFLLSRLLLEDLKKSDYPSTRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRFLFPPFQKYITKG

SEQ ID NO: 10941 - protein, 224 aa, Amaranthus tricolor
KWHVIMACRDFLKAERAAKRIGMPKDSYTVMHLDLASLESVRQFVENFRRSGMPLDVLVCNAAVYLPTDKEPTFTAEGFELSVGTNHLGHFLLSRLLLDDLKQSDYPSKRLIIVGSITGNSNTLAGNVPPKANLGDLRGLAGGLNGVNSSPMIDGGEFDGAKAYKDSKVCNMLTMQEFHRRFHEETGITFSSLYPGCIAETGLFRNHVALFRTLFPPFQKYITK

SEQ ID NO: 10942 - protein, 310 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFNCHLPEPNIAEIPDLDDEYRKVMKEFALKLEKIAEELLDLLCENLGLEKGYLKKAFTWSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVISPAELLVEKETEEKKTAYPKFVFEDYMKLYAGLKFQAKEPRFDAMKAAAKA

SEQ ID NO: 10943 - protein, 369 aa, Vigna radiata
MAVQAASLVSGYFSVAKEGKPGMSLRNTTMFGLSLEDALKADFSSLSFSCKREFQKKVCPLRVQSVATTPGVTKASPEGKKTLRKGSVIITGASSGLGLATAKALAETGKWHVIMACRDFLKAERAAKSSGISKENYTVMHLDLASLDSVRQFVDNFRQSGRPLDVLVCNAAVYLPTASEPTHTADGFELSVGTNHLGHFLLSRLLLEDLNKSDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKFITKGFVSEDESGKRLAQVVEITNKRLWRWLYTKKVGMSV

SEQ ID NO: 10944 - protein, 165 aa, Brassica rapa
MEEESKAKIEETVREILKESDMTEMTEFKVRNLASERLGIDLSDKSHKAFVRGIVKSFLEEVESKQQQQQDKEEEEEEEEERAKEGNKEFDDDGDLIICRLSDKRRVTIQEFRGKSLVSIREYYKKDGKELPSSKGISLTDEQWSTFKKNIPAIEAAVKKMESRV

SEQ ID NO: 10945 - protein, 218 aa, Lotus corniculatus var. japonicus
MGAYRADDDYDYLFKVVLIGDSGVGKSNLLSRFTKNEFSLESKSTIGVEFATRSIRVDDKVVKAQVWDTAGQERYRAITSAYYRGAVGALLVYDVSRHVTFENVERWLKELRDHTDTNIVVMLVGNKADLRHLRAVSTEDSSGFLLNERTHFFMETSALESLNVENAFTEVLTQIYRVVSKKALEIGDDPTALPKGQTINVGSRDDVSPVKKSGCCSS

SEQ ID NO: 10946 - protein, 202 aa, Lotus corniculatus var. japonicus
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTENKVVSYETAKAFADEIGIPFMETSAKNATNVEQAFMAMAAEIKNRMASQPVNNARPPTVQIRGQPVNQKSGCCSS

SEQ ID NO: 10947 - protein, 208 aa, Lotus corniculatus var. japonicus
MSSSSGGYDLSFKILLIGDSGVGKSSLLVSFISSSVEDQSPTIGVDFKIKMLTVGGKRLKLTLWDTAGQERFRTLTSSYYRGAQGIILVYDVTKRETFTNLSEVWSKELELYSNNQDCVKMLVGNKVDRDAARAVSREEGLALAKELGCLLIECSAKTRENVEQCFEELALKIMEAPSLLEEGSTAVKRNILKQKQEPQASQHGGCCS

SEQ ID NO: 10948 - protein, 200 aa, Lotus corniculatus var. japonicus
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMAFAGNKSDLEDKRKVTADEARVYAEENGLFFMETSAKTAANVNDVFYEIAKRLPRAQPAQNPAGMVLVDRPAEGARASSCCS

SEQ ID NO: 10949 - protein, 498 aa, Pisum sativum
MARKMLNDGEPDLKKGEEQGKVYDFDLFIIGAGSGGVRAARFSSNFGAKVGICELPFHPISSETIGGVGGTCVIRGCVPKKILVYGASYGGELQDARNFGWELNENVDFNWKKLLQKKTDEINRLNGIYKRLLSNAGVKLFEGEGKIASPNEVEVTQLDGTKLSYSAKHILIATGSRAQRPNIPGQELGITSDEALSLEEFPKRAVILGGGYIAVEFASIWRGMGSSVNLVFRKELPLRGFDDEMRAVVARNLEGRGINLHPRTNLAQLIKTEDGIKVITDHGEELIADVVLFATGRSPNSKRLNLEKVGVEFDKAGAIVVDEYSRTNIPSIWAVGDVTNRLNLTPVALMEASLFAKTVFGGQASKPDYNDIPYAVFCIPPLSVVGLSEEQAVEQTKGDVLIFTSTFNPMKNTISGRQEKTVMKLVVDAQTDKVLGASMCGPDAPEIVQGIAIAIKCGATKAQFDSTVGIHPSSAEEFVTMRSETRRVTGGVKPKTNL

SEQ ID NO: 10950 - protein, 146 aa, Pisum sativum
MPRSSFSGSLSSPKLDVVIDMGNPFLNLTVDGFLKIGAVAATRSVAEDTFHIIRKGSISSNDFEKSLKKMCKEGAYWGAIAGVYVGMEYGVERIRGTRDWKNAMFGGAVTGALVSAASNNKKDKIAVDAITGAAIATAAEFINYLT

SEQ ID NO: 10951 - protein, 2144 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRTSRRFYYLGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLIPSDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPLGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 10952 - protein, 418 aa, Rhodococcus erythropolis
MTAVSEPDTRTVVIVGTGIAGSGAAQALRKEGFGGSIILIGSETEEPYRRPALSKELLSGKASIDRVRLRPPTFWTEQGIDLRIGVTVTSIDTDSRTVCLVDGDSIDYDVLILAAGGRSRRLTAEDSERVHYLRDIADMRRLQSQLIEGSSLLVVGGGLIGSEVASTARDLGCSVQVLEAQPVPLSRLLPPSIAEKIAALHASAGVALQTGVDLETLTTGVDGVTARARDGREWTADLAVVAIGSLPDTDVAAAAGIAVDNGISVDRYLRTSVIDVYAIGDVANVPNGFLGGMHRGEHWNTAQDHAVAVAKTIVGKEEPFESVPWSWSNQFGRNIQVAGWPGADDTVIVRGDLDSYDFTAICMRDGNIVGAVSVGRPKDIRAVRTLIERSPDISVDVLADSNRDLTELAAGLVASPVL

SEQ ID NO: 10953 - protein, 203 aa, Oryza sativa
MAANPGNKIRNAKLVLLGDVGTGKSSLVLRFVKGQFVEFQESTIGAAFFSQTLAVNDETVKFEIWDTAGQERYHGLAPMYYRGAAAAIVVYDITNAASFTRAKKWVQELQAQGNPNTIMALAGNKADMVEARQVPAEEAKTYAQENGLFFMETSAKTAINVNDVFHEIAKRLLQGQQAQDTPAGMVLNQRPAERMVSSSSCCS

SEQ ID NO: 10954 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 10955 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGTRHYSTPVDVWSVGCIFAEMVTQRPLFPGDSEIDELFKIFRVMGTPNEDTWPGVTTLPDFKSAFPKWPSKDLATIVPNLDGAGLDLLDKTSRLDPSKRITARNALEHEYFKDIGYVP

SEQ ID NO: 10956 - protein, 293 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKNTWITTPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELSRFRVMGTPNEDTWPGVTTLPDFKSAFPKWPSKDLATIVPNLDGAGLDLLDKIVRLDPSKRITARNALEHEYFKDIGYVP

SEQ ID NO: 10957 - protein, 200 aa, Streptomyces sp.
AWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRV

SEQ ID NO: 10958 - protein, 492 aa, Zea mays
MAAEGEAAALEFTPTWIVAAVCSLIVLLSLVAERCLHYLGKTLKRKNQKPLFEALLKVKEELMLLGFISLLLTVFQGMIRRTCIPERWTFHMLPCEKPDEKAGEAATMEHFVGTLGRIGRRLLQEGTAGAEQCQKKGKVPLLSLEAIHQLHIFIFVLAITHVIFSVTTMLLGGAQIHQWKQWENGIKKDAPGNGPKVTNVHHHEFIKKRFKGIGKDSIILSWLHSFGKQFYRSVSKSDYTTMRLGFIMTHCPGNPKFDFHRYMVRVLEADFKKVVGISWYLWVFVVIFLLLNVNGWHTYFWIAFLPLILLLAIGTKLEHVIAQLAHDVAEKHTAVEGDVIVKPSDEHFWFGKPRVILYLIHFILFQNAFEIAFFFWILSTYGFDSCIMGQVRFIVPRLVIGVVIQLLCSYSTLPLYAIVTQMGSCYKKEIFNEHVQQGVLGWAQKVKMKKGLKGAASASKDESITNADSAGPSVKIEMAKAGEDVEIVGNTG

SEQ ID NO: 10959 - protein, 400 aa, Solanum tuberosum
MNKLLTTLLFSSILISTLFSTSYGQNQNCSAFAFRNNQIFATCNALPLLNSVLHWSYHPDNHTVDLAYRHGGVPNTDWVAWGLNIDGTRMVGSQCLVAFRNSSGEIHAYTSPVSSYGTQLAEGALSFNVPRIGAEYSNNEFIIFATLELPAGRTNFNQAWQNGAVSGQALTAHVQSGDNMRSFGSVDFANGELGGGGSSVTSRQRRRNVHGVLNAVSWGVLMPMGAVFARYLKVFKAANPAWFYIHVACQTSAYIVGVAGWGTGLKLGSDSTGIEFTTHRNIGITLFCLGTLQVFALLLRPKPDHKYRLYWNIYHHAVGYAVISLAIANVFEGFDALNGQKNWKRAYTGVIIAIGAIAVLLEAFTWFIVIKRKKTDSNKHTQNGTNGTVNPYGNGTHQQA

SEQ ID NO: 10960 - protein, 402 aa, Solanum tuberosum
MDTKLLTSNLVLFSSILLTLFTFSYGQNCSTHQFTNNNLFSTCNPLPVLNSFLHWTYHPDNHTVDLAYRHGGVTESSWVAWALNLDGTGMAGCQSLIAFRNSSGQIHAYTSPIAGYGTTLTEGALSFGVPRISAEFVRSEMIIFATLELPINRTSFTQVWQNGQVSEQALRVHQTSGDNMRSVGTVDFASGQTSAGAGGGISASARQRRRNIHGVLNAVSWGVLMPMGAIFARYLKVFKSANPAWFYLHAGCQTVAYAVGVAGWGTGLKLGSDSVGIRFDTHRNIGITLFCLGTLQVFALLLRPKPDHKFRLYWNIYHHVTGYTVIILSIINVFEGFDALNGQKNWKKAYIGVIIFLGAIAVLLEAITWFIVIKRKKTSVSDKYPHGNGTNGYASRSHDQTA

SEQ ID NO: 10961 - protein, 400 aa, Solanum tuberosum
MNKLLTTLLFSSILISTLFSTSYGQNQNCSAFAFRNNQIFATCNALPLLNSVLHWSYHPDNHTVDLAYRHGGVPNTDWVAWGLNIDGTRMVGSQCLVAFRNSSGEIHAYTSPVSSYGTQLAKGALSFNVPRIGAEYSNNEFIIFATLELPAGRTSFNQAWQNGAVSGQALTAHVQSGDNMRSFGSIDFANGELGGGGSSVTSRQRRRNVHGVLNAVSWGVLMPMGAVFARYLKVFKAANPAWFYIHVACQTSAYIVGIAGWGTGLKLGSDSTGIEFTTHRNIGITLFCLGTLQVFALLLRPKPDHKYRLYWNIYHHAVGYAVISLAIANVFQGFDALNGQKNWKRAYTGVIIAIGAIAVLLEAFTWFIVIKRKKTDTNKHTQNGTNGTVNPYGNGTHQQA

SEQ ID NO: 10962 - protein, 400 aa, Solanum tuberosum
MNILLTTLLFSSILISTLFSTSYGQNQNCSAFAFRNNQIFATCNALPLLNSVLHWSYHPDNHTVDLAYRHGGVPNTDWVAWGLNIDGTRMVGSQCLVAFRNSSGEIHAYTSPVSSYGTQLAEGALSFNVPRIGAEYSNNEFIIFATLELPAGRTSFNQAWQNGAVSGQALTAHVQSGDNMRSFGSVDFANGELGGGGSSVTSRQRRRNVHGILNAVSWGVLMPMGAVFARYLKVFKAANPAWFYIHVACQTSAYIVGVAGWGTGLKLGSDSTGIEFTTHRNIGITLFCLGTLQVFALLLRPKPDHKYRLYWNIYHHAVGYAVISLAITNVFQGFDALNGQKNWKRAYTGVIIAIGAIAVLLEAFTWFIVIKRKKTDSNKHTQNGTNGTVNPYGNGTHQQA

SEQ ID NO: 10963 - protein, 416 aa, Saccharomyces cerevisiae
  misc_feature (1)..(1): Xaa can be any naturally occurring amino acid
XSKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKKSLSSKLSVQDLDLKDKRVFIRVDFNVPLDGKKITSNQRIVAALPTIKYVLEHHPRYVVLASHLGRPNGERN

SEQ ID NO: 10964 - protein, 401 aa, Guillardia theta
MQEDMEYNIRFVGSYILDKTLGVGATGKVKLAKHSRTKEKVGVKIIKKDLFYDKPSLRLKIQREISVMKLMFHPHVIKIYDVLEDSKYLFLIIEYASKGELFNYLVEKRKLENREALKFFHEIISGLEYCHKHRICHRDLKLENILLDMKLQIKIADFGMASLSIPNIMLKTFCGSPHYASPEVVSNEPYNGIKADIWSCGIILYALVVGKLPYDEENDNMRKLFNKIRFEPPRIPRIIHPDCRDLIRALLTINPQKRITIDKIKKHPWYKSSPLPESCRISIQNLSFASVQNPISNPDPEIISFLLPLQLVKDKKTLCGILSTKKPSFLRVLYRQLEWRKMKMDSVRSNLINEANFKRKKLFKQGKLGNITGLKYWKNLKCKFLSINIKSFVRTGIYIYF

SEQ ID NO: 10965 - protein, 354 aa, Guillardia theta
MSLVGNQRYSVIGRVVGSGSFGVVFQAKCRSNEETVAIKKVFQDDRYENREVEIMSMLVHSNILDLKHCFNFSEGNDLYYNLELEFFAENIHRVCQHYSNHKQTLPTIYVKLYMYQVLRALGYLHSMGICHRDIKPQNLLIDPATQHLKLGDFGSAKLLTLNEPSISYICSRYYRAPELLLGAIDYTNSIDMWSVGCVMGELVIGFPFFRGESGTDQLVEIIKVLGTPTKAQVRAMNNDYLEFQFPRLSSHPWENVFHGKHLEPEAIDLIHKMLDYLPSRRITAIKAISHPFFKQLKIKGAKLPNSKNLPLLFDFSKKEFEYSSRFTTEISTQKYLLFYCKSFLCKWYFGISIC

SEQ ID NO: 10966 - protein, 258 aa, Guillardia theta
MNSSKSRNKILTKRTKYNLKGGLRVIIEKHKYDGVFIARSKQDALCTKNLIIGSSVYGEKRILINKNNDSVEEYRVWNPFRSKLAAVILGGVDDIFLRRGMSVLYLGAANGTTVSHISDIIGIEGTVYAVEFSHRSGRDLLNLAKKRTNVVPIIEDARYPYKYRMLLGITDLVFSDVAQPDQARILSINSKHFLKTGGYFIIAIKASCIDSIVDPNIVFSKEIQKLIRNNFKPSEQLTLEPYERDHAVVLGRFNTKKN

SEQ ID NO: 10967 - protein, 303 aa, Guillardia theta
MDNYKRIEILGQGAYGKVYKAQDLRNGNLVALKKALSSSDEEGIPPTTLREISILKSVSECEFIVKLLDVVNTKSKNGKISIYIVFQYLDSDLKSYMISNYGKGRGMDENSAKKFCFQLLIGMYHCHKLGIIHRDLKPQNILIEKGEKLKIADFGLSRNFSIPVGKYTHEVVTLWYRAPEILLGARTYSSPVDIWSIGCIFAEMLTGNPLFCGESEIEQLLSIFKTIGTPTSQTWPEVLNFKDWHEFPIWPQINLKYSFENISEETLEFIQVFLRLNPNKRISILGAITNTYFEHFFKDYNLY

SEQ ID NO: 10968 - protein, 418 aa, Guillardia theta
MLILYDSVIGYCLFSVNENIINKYIDIEYENFISSYQNFSKIFKIKFFLPFKSLKHSLQNTVLINQSKISKSLQKILHLAFDLKEKNNIGVFDSKLAFKLNKIFNNYLIVDEKCLKLIKTIRLYFDRIIEKLIPNDIKKTRNGVAHFYSELKLKMSSSNLEFSIIQSSMILDQLDKDNNFFSTMCRELYSFHFPELSNLIKDNFNFCLLVKLIGDKKTLNINNFKEILLIIYNERLTYEIIKSSNQSIGICMDKIDYILLEKIANLVIASFELKNVLIKHIKAKMKKVCPNLVNLIGEVLGSKILSHAGSLKNLAKLPSSTIQILGAEKNLFSALKKNEKTPKYGIIVNSKLISKISNSNKYKFARYIANKISLSARIDFFSGAKCTSYGKNFKSQIKIQISSIDMSGIRTRDNLLAP

SEQ ID NO: 10969 - protein, 389 aa, Guillardia theta
MNCYCLYVGDLNVSLKDIDLERIFRKDYEISGLRICKDIFSGNSLGYSYVYFNSYSSAKKALNDMNFYSDTELFKTPIRIMWKNNNNSIRKSGYGNLFIKNLPYNFSPKDLHSLFSEYGEILSSKIKYDNEGSSLGYGFVHYKEMKDAISAINNLNGKLISNKMITVKHFLNKSQRERISSCDLFTNIYVKNLPVDKLSEKVIFNLFGVFGKITSIFIPLWYNSIPKGFAYINFENHEDAEEAIITMNNRKIAGKSLIVCKAINKIKIDTINKKSRNYCMNNSLLINKLEYNQKKNIGSDIENSSNSSKADKSILIEIFSSKINYQYMHKIIIINLIYMSLKNNCKLNVEKILNLFIKLKSKDIEKIIFMKKSKKKKILINFKNKYLKI

SEQ ID NO: 10970 - protein, 472 aa, Guillardia theta
MNKLFSIKIGPYYLGKTLGVGSFGKVKLGEHELCGQKVAVKILNRKKIKNLKMEEKVKREICILKLFMHPHIIRLYEVIETPTDIFVVTEYITGGELFDYIVERGRLNEDESRKFFQQMISGIEYCHNHMVVHRDLKPENILLDAHLNVKIADFGLSNIMKDGNFLKTSCGSPNYAAPEVINGKSYLGPEVDVWSCGVIMYALLCGSLPFDDENIPNLFKKIKSGIYILPGYLSDLSRDMIAKMLITNPLLRITINEIRDHPWFNSRLPKYLSFPTFKKNFVIQKKLNIDDNILELVSNKTFLSKKYIKLGIMKHERNSTAIIYHLIRESITPFDMITVDNSYIRDIIKKENVIKKSNEKEHNTSLHQAFLGIESPRENLKDILNEIQRAIKTFRSKTHNLNHFSVIIVINTNSLFETKYKKKKEIILRTTTILIQIFKRSMKYLIDLQKINGDSFFFLSTCNFIKQELNLK

SEQ ID NO: 10971 - protein, 374 aa, Guillardia theta
MTQKKTVLAENSKIGNFAYSRFHPMQPIRLSMTSELIYSYGMEKFLRIIRTEKKTNSEMFNIHSSIFEFNVIKKKNFESINYITIDKYDADCPIFKGLNEYLLLYSSASLLSLDELTNNNCQIAINWSGGLHHSKIDEKSGFCYLNDINLCILNLLKHFNYILYIDIDVHHGDGVEEVFYATNRVFVLSFHFYNKNFFPGSGSITNKGISIGKYASYNVPIKKNIGDENYCNIFESIVREIIESVRPDIIILQSGADSLSFDVIGRFNLSINGHSNCLNFLKKFNIPILVLGGGGYIKDRVSKCWTFETSIAIDKKIKYNIPNNIYWKLYRPNFHLDIEKKDKANDFNTKKYLDFIDSEIKKNIRFHKNNIKLF

SEQ ID NO: 10972 - protein, 318 aa, Streptomyces coelicolor A3(2)
MRAVQFDRFGPPDVLRVNDVPAPRPGPGEVLVEVRAASVDAGETAFRAGRMRRVTRVRFPRGLGSDFAGRVAALGSGVRAWSVGDAVWGLMPHLTFGAIADYVAVPEQRLARAPQNLDLLEAAALPVVGTTAMTALSGKARLQPGERLLVRGATGGVGSVAVQLGKALGAHVTALAAARNLDWITRLGADEAVDYRTTRPEDLDRFDVIVDVVGTDLGAYRKRLARGGRLVALSFDSDRVVSSMLGIALRAAATPRRVKMFSNNPSADRIAELTRAVEAGTIRPVVDTVFPMRDIAAVHQRLEAGGVRGKYVVDLRLP

SEQ ID NO: 10973 - protein, 470 aa, Sulfolobus solfataricus P2
MMSLEVIEVRSPSNLKVIGTVKRMSKDEVRGEIEEAYKGFEIISRMPLYKRTAILRKISEILEREQERLARLLAMEAGKPISDSRVEVLRASRLFRQAAEEVGIVLEGKNYRVDAYEYPPGNENRIVLSTREPIGVVTAILPFNFPINSFAHKVAPALAVGNSVVVKPSINTPLAAVEMKKILVEAGLPDSAVRVVTGYSSEIGDEIITHPLVGLITLTGSTQTGLKIASKAISLGKRIIMELGGSDPIIILEDANIERASSIAVRARFEYAGQNCNAGKRIIVRQEVYDKFVKAFNEKAKALKVGEPLDETTDVGPVINKESVENLNSVLEDAKVKGGRVEILNRGPESGSFFPLTMVTNPSLDMLVLKSEVFGPIVPIVSVKSDEEAIRIANSTEYGLQSAIFTNDVNRALKLSRELKFGAVIINDSTRLRWDSLPFGGFKKTGIGREGVRETMLEMTENKLIAITLL

SEQ ID NO: 10974 - protein, 238 aa, Helianthus tuberosus
QHPCRSNVAVKKELHTPESDRSCTHLEFDISNTGLSYETGDHVGVYCENLSEVVDEAERLVGLPRDTYFSVHTDNEDGTPLSGASLPPPFPPCTLRKALACYADVLSSPKKSALLALAAHATDPSEADRLKFLASPAGKDEYSQWIVASQRSLLEAMEAFPSAKPPVGVFFASVPPALQPRYYSISSSPKMAPNRIHVTCALVYEKTPAGRVHKGVCSTWMKNAVPMTESQDCSWAPI

SEQ ID NO: 10975 - protein, 313 aa, Sulfolobus solfataricus P2
MVDVIALGEPLIQFNSFNPGPLRFVNYFEKHVAGSELNFCIAVVRNHLSCSLIARVGNDEFGKNIIEYSRAQGIDTSHIKVDNESFTGIYFIQRGYPIPMKSELVYYRKGSAGSRLSPEDINENYVRNSRLVHSTGITLAISDNAKEAVIKAFELAKSRSLDTNIRPKLWSSLEKAKETILSILKKYDIEVLITDPDDTKILLDVTDPDEAYRKYKELGVKVLLYKLGSKGAIAYKDNVKAFKDAYKVPVEDPTGAGDAMAGTFVSLYLQGKDIEYSLAHGIAASTLVITVRGDNELTPTLEDAERFLNEFKT

SEQ ID NO: 10976 - protein, 366 aa, Escherichia coli
MLPLHLLPVNRWKSLKLTLHHRKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 10977 - protein, 1803 aa, Euglena gracilis
MKQSVRPIISNVLRKEVALYSTIIGQDKGKEPTGRTYTSGPKPASHIEVPHHVTVPATDRTPNPDAQFFQSVDGSQATSHVAYALSDTAFIYPITPSSVMGELADVWMAQGRKNAFGQVVDVREMQSEAGAAGALHGALAAGAIATTFTASQGLLLMIPNMYKIAGELMPSVIHVAARELAGHALSIFGGHADVMAVRQTGWAMLCSHTVQQSHDMALISHVATLKSSIPFVHFFDGFRTSHEVNKIKMLPYAELKKLVPPGTMEQHWARSLNPMHPTIRGTNQSADIYFQNMESANQYYTDLAEVVQETMDEVAPYIGRHYKIFEYVGAPDAEEVTVLMGSGATTVNEAVDLLVKRGKKVGAVLVHLYRPWSTKAFEKVLPKTVKRIAALDRCKEVTALGEPLYLDVSATLNLFPERQNVKVIGGRYGLGSKDFIPEHALAIYANLASENPIQRFTVGITDDVTGTSVPFVNERVDTLPEGTRQCVFWGIGSDGTVGANRSAVRIIGDNSDLMVQAYFQFDAFKSGGVTSSHLRFGPKPITAQYLVTNADYIACHFQEYVKRFDMLDAIREGGTFVLNSRWTTEDMEKEIPADFRRNVAQKKVRFYNVDARKICDSFGLGKRINMLMQACFFKLSGVLPLAEAQRLLNESIVHEYGKKGGKVVEMNQAVVNAVFAGDLPQEVQVPAAWANAVDTSTRTPTGIEFVDKIMRPLMDFKGDQLPVSVMTPGGTFPVGTTQYAKRAIAAFIPQWIPANCTQCNYCSYVCPHATIRPFVLTDQEVQLAPESFVTRKAKGDYQGMNFRIQVAPEDCTGCQVCVETCPDDALEMTDAFTATPVQRTNWEFAIKVPNRGTMTDRYSLKGSQFQQPLLEFSGACEGCGETPYVKLLTQLFGERTVIANATGCSSIWGGTAGLAPYTTNAKGQGPAWGNSLFEDNAEFGFGIAVANAQKRSRVRDCILQAVEKKVADEGLTTLLAQWLQDWNTGDKTLKYQDQIIAGLAQQRSKDPLLEQIYGMKDMLPNISQWIIGGDGWANDIGFGGLDHVLASGQNLNVLVLDTEMYSNTGGQASKSTHMASVAKFALGGKRTNKKNLTEMAMSYGNVYVATVSHGNMAQCVKAFVEAESYDGPSLIVGYAPCIEHGLRAGMARMVQESEAAIATGYWPLYRFDPRLATEGKNPFQLDSKRIKGNLQEYLDRQNRYVNLKKNNPKGADLLKSQMADNITARFNRYRRMLEGPNTKAAAPSGNHVTILYGSETGNSEGLAKELATDFERREYSVAVQALDDIDVADLENMGFVVIAVSTCGQGQFPRNSQLFWRELQRDKPEGWLKNLKYTVFGLGDSTYYFYCHTAKQIDARLAALGAQRVVPIGFGDDGDEDMFHTGFNNWIPSVWNELKTKTPEEALFTPSIAVQLTPNATPQDFHFAKSTPVLSITGAERITPADHTRNFVTIRWKTDLSYQVGDSLGVFPENTRSVVEEFLQYYGLNPKDVITIENKGSRELPHCMAVGDLFTKVLDILGKPNNRFYKTLSYFAVDKAEKERLLKIAEMGPEYSNILSEMYHYADIFHMFPSARPTLQYLIEMIPNIKPRYYSISSAPIHTPGEVHSLVLIDTWITLSGKHRTGLTCTMLEHLQAGQVVDGCIHPTAMEFPDHEKPVVMCAMGSGLAPFVAFLRERSTLRKQGKKTGNMALYFGNRYEKTEFLMKEELKGHINDGLLTLRCAFSRDDPKKKVYVQDLIKMDEKMMYDYLVVQKGSMYCCGSRSFIKPVQESLKHCFMKAGGLTAEQAENEVIDMFTTGRYNIEAW

SEQ ID NO: 10978 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHSKSAESNMCDLLRINTDRGVMIGDGKSRFSINGKPIYHFVGTSTFSEYTVMHVGCVAKINPEAPLDKVCVLSCGISSGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 10979 - protein, 379 aa, Pennisetum glaucum
MATAGKVIKCKAAVAWEAGKPLSIEEVEVAPPQAMEVRVNILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 10980 - protein, 249 aa, Aruncus dioicus
SWHNDTDCCNWYCVTCDSTTNRINSFTVSGGLSGQIPPQVGDLPYLENLDIRKHPNLTGPIQPTIAKLKKLTFLRLNWNNLSGSVPDFLSELKNLTFLDLSFNNLTGSIPSSLSRLQNLYGLRLDRNKLTGPIPKSFGDFPVNAPTIFLSYNQLSGKIPTSLAKLDFSQIDLSRNKLEGDASMIFGENKTTQIVDLSRNLLEFNLSKVQFSKSLTAIDLNHNKIFGSIPAVFTQLNFQLLYVSYNRLCG

SEQ ID NO: 10981 - protein, 249 aa, Aruncus dioicus
SWHNDTDCCNWYCVTCDSTTNRINSFTVSGGLSGQIPPQVGDLPYLENLDIRKHPNLTGPIQPTIAKLKKLTFLRLNWNNLSGSVPDFLSELKNLTFLDLSFNNLTGSIPSSLSRLQNLYGLRLDRNKLTGPIPKSFGDFPVNAPTIFLSYNQLSGKIPTSLAKLDFSQIDLSRNKLEGDASMIFGENKTTQIVDLSRNLLEFNLSKVQFSKSLTAIDLNHNKIFGSIPAVFTQLNFQLLNVSYNRLCG

SEQ ID NO: 10982 - protein, 242 aa, Cercocarpus ledifolius
  misc_feature (231)..(232): Xaa can be any naturally occurring amino acid
SWNPDNDCCDWYCVTCDSTTNRINSLTIFAGDLPGQIPAQVGDLPYLQTLEFHKLSSLSGPIQPSIAKLKSLTSLRISNTNISGSVPDFLSQLKNLNFLDLSFNNLTGSIPSSLSKLRNLNALHLDRNKLTGHIPYSFGQFQGTIPDLYLSHNQLSGKIPTSFATMDFNRIDLSRNKLEGDASVIFGENKTTQIVDLSRNLLEFDLSKVKFPTSLTSLDINHNSIEGSIPXXDDPTAGLAFL

SEQ ID NO: 10983 - protein, 250 aa, Chaenomeles speciosa
SWKSDTDCCDWYCVTCDSTTNRINSLTIFAGQVSGQIPALVGDLPYLETLEFHKQPNLTGPIQPAIAKLKGLKFLRLSWTNLSGSVPDFLSQLKNLTFLDLSFNNLTGAIPSSLSQLPNLNAIHLDRNKLTGHIPKSLGQFIGNVPDLYLSHNQLSGNIPTSFAQMDFTSIDLSRNKLEGDASVIFGLNKTTQIVDLSRNLLEFNLSKVEFPTSLTSLDINHNKIYGSIPVEFTQLNFQFLNVSYNRLCG

SEQ ID NO: 10984 - protein, 250 aa, Crataegus monogyna
SWKSDTDCCDWYCVTCDSTTNRINSLTIFAGQVSGQIPALVGDLPYLETLEFHKQPNLTGPIQPAIAKLKGLKFLRLSWTNLSGSVPDFLSQLKNLTFLDLSFNNLTGAIPSSLSQLPNLNALHLDRNKLTGHIPKSLGQFIGNVPALYLSHNQLSGNIPTSFAQMDFTSIDLSRNKLEGDASVIFGLNKTTQIVDLSRNLLEFNLSKVEFPTSLTSLDINHNKIYGGIPGEFTQLNFQFLNVSYNRLCG

SEQ ID NO: 10985 - protein, 253 aa, Fragaria vesca
SWKSDADCCTDWYNVECDPNTNRINSLTIFTDDRLTGQIPAQVGDLPYLETLVLRKLPNLTGPIQPSIAKLKHLKMLRLSWNGLSGSVPDFLSQLKNLTFLELNYNNFTGSVPSSLSKLPNLLALHLDRNQLTGNIPSSYGKFVGTVPDLFLSHNKLTGKIPTSFANMNFDRIDLSRNMLEGDASMIFGMNKTTQIVDLSRNMLEFDLSKVVFSTSLISLDLNHNRMTGSIPEQLTQLDNLQLFNVSYNRLCG

SEQ ID NO: 10986 - protein, 250 aa, Heteromeles arbutifolia
SWKSDTDCCDWYCVTCDSTTNRIKSLTIFAGQVSGQIPALVGDLPYLETLEFHKQPNLTGPIQPAIAKLKGLKFLRLSWTNLSGSVPDFLSQLKNLTFLDLSFNNLTGTIPSSLSQLPNLNALHLDRNKLTGHIPKSLGQFIGNVPDLYLSHNQLSGNIPTSFAQMDFTSIDLSRNKLEGDASVIFGLNKTTQIVDLSRNLLEFNLSKVEFPTSLTSLDINHNKIYGSIPVEFTQLNFQFLNLSYNRLCG

SEQ ID NO: 10987 - protein, 252 aa, Horkelia cuneata
SWKPDVDCCTTWNNVECDPITNRITSLSILSYDQVSGHIPPQVGDLPYLEQLVIRKQPNVTGPIQPAIAKLKNLKWLRLGWNNLSGSVPDFISQLKNLTFIELNYNNLTGSIPSSLSLLPNLASLRLDRNKLTGKIPSSFGRFVGVLPDLYLSHNQLTGKIPTSLGNMDFRAIDLSRNMLEGDASFLFGLNKTTQIADLSRNMLEFDLSKAKFSKSLISLDLNHNRLTGGIPEQLTEVKLQFFNVSYNRLCG

SEQ ID NO: 10988 - protein, 230 aa, Horkelia cuneata
SWKPDVDCCTTWNNVECDPITNRITSLSILSYDQVSGHIPPQVGDLPYLEQLVIRKQPNVTGPIQPAIAKLKNLKWLRLGWNNLSGSVPDFISQLKNLTFIELNYNNLTGSIPSSLSLLPNLASLRLDRNKLTGKIPSSFGRFVGVLPDLYLSHNQLTGKIPTSLGNMDFRAIDLSRNMLEGNASFLFGLNKTTQVADLSRNMLEFDLSKAKFSKSLISLDLNHNRLTGS

SEQ ID NO: 10989 - protein, 250 aa, Lyonothamnus floribundus
SWKPDTDCCDWYCVTCDSTTNRINSLTIFAGSVTGKIPTQVGDLPYLETLEFHKQPNLTGPIQPSIVKLKSLKFLRLSWTNISGSVPDFLSQLKNLTFLDLSFNNLTGSIPSSLSQLTNLNALHLDRNKLTGHIPKSFGEFHGNVPELYLSHNQLSGNIPTSFAQMDFNRIDLSRNKLEGDAFMIFGSNKTTQIVDLSRNLLKFYLSKVEFPNSLTSLDINHNSITGPIPVEMTQLNLQFLNVSYNRLCG

SEQ ID NO: 10990 - protein, 248 aa, Lyonothamnus floribundus
SWKPDTDCCDWYCVTCDSTTNRINSLTIFAGSVTGKIPTQVGDLPYLETLEFHKQPNLTGPIQPSIVKLKSLKFPRLSWTNISGSVPDFLSQLKNLTFLDLSFNNLTGSIPSSLSQLTNLNALHLDRNKLTGHIPKSFGEFHGNVPKLYLSHNQLSGNIPTSFAQMDFNRIDLSRNKLEGDAFMIFGSNKTTQIVDLSRNLLKFNLSKVEFPNSLTSLDINHNSITGPIPVEMTQLNLQFLNVSYNRQ

SEQ ID NO: 10991 - protein, 250 aa, Lyonothamnus floribundus
SWKPDTDCCDWYCVTCDSTTNRINSLTIFAGSVTGKIPTQVGDLPYLETLEFHKQPNLTGPIQPSIVKLKSLKFLRLSWTNISGSVPDFLSQLKNLTFLDLSFNNLTGSIPSSLSQLTNLNALHLDRNKLTGHIPKSFGEFHGNVPELYLSHNQLSGNIPTSFAQMDFNRIDLSRNKLEGDAFMIFGSNKTTQIVDLSRNLLKFNLSKVEFPNSLTSLDINHNSITGPIPVEMTQLNLQFLNVSYNRLCG

SEQ ID NO: 10992 - protein, 250 aa, Photinia serrulata
SWKSDTDCCDWYCVTCDSTTNRINSLTIFAGQVSGQIPALVGDLPYLETLEFHKQPNLTGPIQPAIAKLKGLKFLRLSWTNLSGSVPDFLSQLKNLTFLDLSFNNLTGTIPSSLSQLPNLNALHLDRNKLTGHIPKSLGQFIGNVPDLYLSHNQLSGNIPTSFAQMDFTSIDLSRNKLEGDASVIFGLNKTTQIVDLSRNLLEFNLSKVEFPTSLTSLDINHNKIYGSIPVEFTQLNFQFLNVSYNRLCG

SEQ ID NO: 10993 - protein, 250 aa, Physocarpus capitatus
SWNPDNDCCDWYSVTCDSTNNRINSLTIFAGEVSGQIPTQVGDLPYLETLEFHKQPNLTGPIQPSIVKLKSLKFLRLSWTNLSGSIPDFLSQLKNLTFLDLSFGNFTGSIPSSLSELPNLNALHLDRNKLTGHIPKSFGEFQGSVPDLYLSHNQLSGSIPTSFAKMDFSRIDLSRNKLEGDASVIFGPNKTTQIVDLSRNLLEFNLSKVVFPKSLTSLDINHNKITGSIPVELTQLDLQFLNVSYNRLCG

SEQ ID NO: 10994 - protein, 250 aa, Physocarpus capitatus
SWNPDNDCCEWYSVTCDSTNNRINSLTIFAGEVSGQIPTQVGDLPYLETLEFHKQPNLTGPIQPSIVKLKSLKFLRLSWTNLSGSIPDFLSQLKNLTFLDLSFGNFTGSIPSSLSKLPNLNALHLDRNKLTGHIPKSFGEFQGSVPDLYLSHNQFSGSIPTSFAKMDFSRIDLSRNKLEGDASVIFGLNKTTQIVDLSRNLLEFNLSKVVFPKSLTSLDINHNKITGSIPVELTQLDLQFLNVSYNRLCG

SEQ ID NO: 10995 - protein, 250 aa, Physocarpus opulifolius
  misc_feature (97)..(97): Xaa can be any naturally occurring amino acid
SWNPDNDCCDWYSVTCDSTNNRINSLTIFAGEVSGQIPTQVGDLPYLETLEFHKQPNLTGPIQPSIVKLKSLKFLRLSWTNLSGSIPDFLSQLKNLXFLDLSFGNFTGSIPSSLSKLPNLNALHLDRNKLTGHIPKSFGEFQGSVPDLYLSHNQLSGSIPTSFAKMDFSRIDLSRNKLEGDASVIFGPNKTTQIVDLSRNLLEFNLSKVVFPKSLTSLDINHNKITGSIPVELTQLDLQFLNVSYNRLCG

SEQ ID NO: 10996 - protein, 250 aa, Physocarpus opulifolius
SWNPDNDCCDWYSVTCDSTNNRINSLTIFAGEVSGQIPTQVGDLPYLETLEFHKQPNLTGPIQPSIVKLKSLKFLRLSWTNLSGSIPDFLSQLKNLTFLDLSFGNFTGSIPSSLSKLPNLNALHLDRNKLTGHIPKSFGEFQGSVPDLYLSHNQLSGSIPTSFAKMDFSRIDLSRNKLEGDASVIFGPNKTTQIVDLSRNLLEFNLSKVVFPKSLTSLDINHNKITGSIPVELTQLDLQFLNVSYNRLCG

SEQ ID NO: 10997 - protein, 250 aa, Gillenia stipulata
SWNPAHDCCDWYCDTCDSTTNRINSLTIFAGQVSGQIPALVGDLPYLETLEFHKQPNLTGPIQPSIAKLKSLKFLRLSWTNISGSVPDFLSQLKNLTFLDLSFNNLTGAIPSSLSQLPNLNSLRLDRNKLTGHIPKSFGQFSGNVPDLILSHNQLSGNIPTSFSQMNFNRIDLSRNKLEGDASMVFGLNKTTQIADLSRNLLEFNLSKVEFPTSLISLDMNHNKIYGSIPVELTQVNLQFLNVSYNKLCG

SEQ ID NO: 10998 - protein, 250 aa, Gillenia trifoliata
SWNPDNDCCDWYCVTCDSTTNRINSLTIFSGQVSGQIPALVGDLPHLETLEFHKQPNLTGPIQPSIAKLKSLKFLRLSWTNISGSVPDFLSQLKNLTLLDLSFNNLTGAIPSSLSQLPNLNSLHLDRNKLTGHIPKSFGQFSGNVPDLILSHNQLPGNIPTSFAQMNFDRIDLSRNKLEGDASMVFGLNKTTQIADLSRNLLEFNLSKVEFPTSLISLDINHNKIYGSIPVELTQVNLQFLNVSYNRLCG

SEQ ID NO: 10999 - protein, 252 aa, Potentilla anserina
SWKSDVDCCTTWNNVECDPTTNRIISLTIVPYNQLSGQIPPQVGDLPYLETLVIRKQPNVTGPIQPSIVKLKHLKELRLGWNNLTGSVPDFFSQLKNLTLIELNYNNLTGSIPSSLSQLPNLASLHLDHNKLTGKIPSSLGQFVGVIPDLDLSHNQLTGKIPTSLGNMDFRSIDLSRNMVEGDASFLFGLKKMTQIIDLSRNMLEFDLSKAEFSQSLISLNLNHNRLTGSIPEELTEVKLQFFNVSYNRLCG

SEQ ID NO: 11000 - protein, 252 aa, Potentilla anserina
SWKSDVDCCTTWNNVECDPTTNRIISLTIVPYNQLPSQIPPQVGDLPYLETLVIRKQPNVTGPIQPSIVKLKHLKELRLGWNNLTGSVPDFFSQLKNLTSIELNYNNLTGSIPSSLSQLPNLASLHLDHNKLTGKIPSSLGQFVGVIPDLDLSHNQLTGKIPTSLGNMDFRSIDLSRNMVEGDASFLFGLNKTTQIIDLSRNMLEFDLSKAEFSQSLISLNLNHNRLTGSIPEELTEVKLQFFNVSYNRLCG

SEQ ID NO: 11001 - protein, 250 aa, Pyracantha fortuneana
SWKSDTDCCDWYCVTCDSTTNRINSLTIFAGQVSGQIPALVGDLPYLETLEFHKQPNLTGPIQPAIAKLKGLKFLRLSWTNLSGSVPDFLSQLKSLTFLDLSFNNLTGAIPSSLSQLPNLNALHLDRNKLTGHIPNSLGQFIGNVPDLYLSHNQLSGSIPTSFAQMDFTSIDLSRNKLEGDASVIFGVNKTTQIVDLSRNLLEFNLSKVEFPTSLTSLDINHNKIYGSTPAEFTQLNFQFLNVSYNRLCG

SEQ ID NO: 11002 - protein, 250 aa, Pyracantha fortuneana
SWKSDTDCCDWYCVTCDSTTNRINSLTIFAGQVSGQIPALVGDLPYLETLEFHKQPNLTGPIQPAIAKLKGLKFLRLSWTNLSGSVPDFLSQLKSLTFLDLSFNNLTGAIPSSLSQLPNLNALHLDRNKLTGHIPNSLGQFIGNVPDLYLSHNQLSGSIPTSFAQMDFTSIDLSRNKLEGDASVIFGVNKTTQIVDLSRNLLEFNLSKVEFPTSLTSLDINHNKIYGSIPAEFTQLNFQFLNVSYNRLCG

SEQ ID NO: 11003 - protein, 250 aa, Rhamnus californica
SWKSDTDCCDWYCVSCHPTTHRINSLTIFSGQLSGKIPSGVGDLPYLETLEFHKLSNLTGPVQPSIAKLKSLKFLRISWTNISGSVPDFLSQLKNLTFLDLSFNDLTGSIPSSLSLLPNLDAIHLDRNKLTGPIPDSFGAFHSKVPELYLSHNQLSGSIPASLANMDFNVVDLSRNKLEGDASIIFGSNKTTQRVDLSRNLLEFDLSNVKFPESLTYLDVNHNKIMGSLPTALTALNLQYLNVSYNRLCG

SEQ ID NO: 11004 - protein, 250 aa, Rhamnus californica
SWKSDTDCCDWYCVSCHPTTHRINSLTIFSGQLSGKIPSGVGDLPYLETLEFHKLSNLTGPVQPSIAKLKSLKFLRISWTNISGSVPDFLSQLKNLTFLDLSFNDLTGSIPSSLSLLPNLDAIHLDRNKLTGPIPDSFGAFHSKVPELYLSHNQLSGSIPASLANMDFNVVDLSRNKLEGDASIIFGSNKTTQRMDLSRNLLEFDLSNVKFPESLTYLDVNHNKIMGSLPTALTALNLQYLNVSYNRLCG

SEQ ID NO: 11005 - protein, 250 aa, Stephanandra chinensis
SWNPDNDCCDWYSVTCDSTTNRINSLTIFAGEVSGQIPTQVGDLPYLETLEFHKQPNLTGPIQPSIVKLKSLKFLRLSWTNLSGSVPDFLSQLKNLTFLDLSFSNFTGSIPSSLSKLPNLNALHLDRNKLTGHIPESFGEFQGSVPDLYLSHNQLSGSIPTSFAKMDFSSIDLSRNKLEGDASMIFGSNKTTQIVDLSRNLLEFNLSKVVFPKSLTSLDLNHNQITGSIPVELTQLDLQFLNVSYNRLCG

SEQ ID NO: 11006 - protein, 250 aa, Stephanandra chinensis
SWNPDNDCCDWYSVTCDSTTNRINSLTIFAGEVSGQIPTQVGDLPYLETLEFHKQPNLTGPIQPSIVKLKSLKFLRLSWTNLSGSVPDFLSQLKNLTFLDLSFSNFTGSIPSSLSKLPNLNALHLDRNKLTGHIPKSFGEFQGSVPDLYLSHNQLSGSIPTSFAKMDFSRIDLSRNKLEGDASMIFGSNKTTQIVDLSRNLLEFNLSKVVFPKSLTSLDLNHNQITGSIPVELTQLDLQFLNVSYNRLCG

SEQ ID NO: 11007 - protein, 386 aa, Bruguiera gymnorrhiza
MAKPVSIEVWNPRGRYRVVSTKPMPGTRWINLLVQQDCRLEICTEKKTILSVEDIIALMGDKCDGVIGQLTEDWGETLFAALSKAGGKAFSNMAVGYNNVDVNAANKYGVAVGNTPGVLTETTAELAASLSLAAARRIVEADEFMRAGLYDGWLPNLFVGNLLKGQTVGVIGAGRIGSAYARMMVEGFKMNLIYYDLYQATRLEKFVTAYGQFLKANGEQPVTWKRAATMDEVLREADVISLHPVLDKTTYHLINKESLASMKKEAVLVNCSRGPVIDEVALVEHLRRNPMFRVGLDVFEDEPYMKPGLADMKNAIVVPHIASASKWTREGMATLAALNVLGKIKGYPVWGDPNRVEPFLNENAPPPAACPSIVNSKALGLPVSKL

SEQ ID NO: 11008 - protein, 511 aa, Bruguiera gymnorrhiza
MAMASFARRKAYLLTRNLSNNSCSDALSCSFCLSSFSRGFASAGSDDNDVVVIGGGPGGYVAAIKAAQLGLKTTCIEKRGALGGTCLNVGCIPSKALLHSSHMFHEAKHSFASHGVKFSSVEIDLPAMMAQKEKAVSTLTKGIEGLFKKNKVTYVKGYGKFVSPSEVSVDTLEGGNIVVKGKNIIIATGSDVKSLPGITIDEKKIVSSTGALALSEIPRKLVVIGAGYIGLEMGSVWGRLGSEVTVVEFAPDIVPSMDGEIRKQFQRTLEKQKMKFILKTKVVGVDTSGDGVKLTLEPASGGNQTTLEADVVLASAGRIPFTAGLGLDKIGVETDKVGRVLVNDRFQTNASGVYAIGDVIPGPMLAHKAEEDGVACVEFIAGTHGHVDYDKVPGVVYTHPEVASVGKTEEQVKSLGIDYRVGKFPFLANSRAKAIDDAEGIVKILAEKETDKVLGVHIMSPNAGELIHEAVLALTYDASSEDIARVCHAHPTMSEALKEAAMATYDKPIHI

SEQ ID NO: 11009 - protein, 486 aa, Arabidopsis thaliana
MMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 11010 - protein, 491 aa, Mycobacterium tuberculosis CDC1551
MMTTESVARKTQKSETEAPREPAPVSDEKQTDVAKTVARLRKTFASGRTRSVEWRKQQLRALQKLMDENEDAIAAALAEDLDRNPFEAYLADIATTSAEAKYAAKRVRRWMRRRYLLLEVPQLPGRGWVEYEPYGTVLIIGAWNYPFYLTLGPAVGAIAAGNAVVLKPSEIAAASAHLMTELVYRYLDTEAIAVVQGDGAVSQELIAQGFDRVMFTGGTEIGRKVYEGAAPHLTPVTLELGGKSPVIVAADADVDVAAKRIAWIKLLNAGQTCVAPDYVLADATVRDELVSKITAALTKFRSGAPQGMRIVNQRQFDRLSGYLAAAKTDAAADGGGVVVGGDCDASNLRIQPTVVVDPDPDGPLMSNEIFGPILPVVTVKSLDDAIRFVNSRPKPLSAYLFTKSRAVRERVIREVPAGGMMVNHLAFQVSTAKLPFGGVGASGMGAYHGRWGFEEFSHRKSVLTKPTRPDLSSFIYPPYTERAIKVARRLF

SEQ ID NO: 11011 - protein, 273 aa, Mycobacterium tuberculosis CDC1551
MRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRPSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 11012 - protein, 467 aa, Mycobacterium tuberculosis CDC1551
MQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 11013 - protein, 396 aa, Mycobacterium tuberculosis CDC1551
MMSTPTPPALDRDDPLGLDASLSSDEIAVRDTVRRFCAEHVTPHVAAWFEDGDLPVARDLAKQFGELGLLGMQLHGHGCGGASAVHYGLACRELEAADSGIRSLVSVQGSLAMFAIASFGSDEQKRQWLPGMATGDLLGCFGLTEPDVGSDPAAMKTRARRDGPDWVITGGKMWITNGSVADVAIVWAATDDGIRGFIVPTDTPGFTANTIGHKLSLRASITSELVLDNVRLPADAMLPGATGLRAPLACLSEARYGIVWGAMGAARSAWQCALDYARQRTQFGRPIAGFQLTQAKLVDMAVELHKGQLLSLHLGRLKDRVGLRPDQVSFGKLNNTREALKICRTARTILGGNGISLEYPVIRHMVNLESVLTYEGTPEMHQLVLGQAFTGLAAFR

SEQ ID NO: 11014 - protein, 338 aa, Mycobacterium tuberculosis CDC1551
MQEAPHRVMPLVRPCPRPSDPGEYVRPMTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 11015 - protein, 1306 aa, Mycobacterium tuberculosis CDC1551
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLRAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 11016 - protein, 336 aa, Mycobacterium tuberculosis CDC1551
MGVSIEVNGLTKSFGSSRIWEDVTLTIPAGEVSVLLGPSGTGKSVFLKSLIGLLRPERGSIIIDGTDIIECSAKELYEIRTLFGVLFQDGALFGSMNLYDNTAFPLREHTKKKESEIRDIVMEKLALVGLGGDEKKFPGEISGGMRKRAGLARALVLDPQIILCDEPDSGLDPVRTAYLSQLIMDINAQIDATILIVTHNINIARTVPDNMGMLFRKHLVMFGPREVLLTSDEPVVRQFLNGRRIGPIGMSEEKDEATMAEEQALLDAGHHAGGVEEIEGVPPQISATPGMPERKAVARRQARVREMLHTLPKKAQAAILDDLEGTHKYAVHEIGQ

SEQ ID NO: 11017 - protein, 406 aa, Mycobacterium tuberculosis CDC1551
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADVTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 11018 - protein, 342 aa, Mycobacterium tuberculosis CDC1551
MEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 11019 - protein, 362 aa, Mycobacterium tuberculosis CDC1551
MSASLPVFPWDTLADAKALAGAHPDGIVDLSVGTPVDPVAPLIQEALAAASAAPDYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 11020 - protein, 2101 aa, Mycobacterium tuberculosis CDC1551
MGFGSIHPRLVQGDCVVRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGDVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 11021 - protein, 448 aa, Mycobacterium tuberculosis CDC1551
MGPPPAARRREGEPDNQDPAGLLTDKYELTMLAAALRDGSANRPTTFEVFARRLPTGRRYGVVAGTGRLLEALPQFRFDADACELLAQFLDPATVRYLREFRFRGDIDGYAEGELYFPGSPVLSVRGSFAECVLLETLVLSIFNHDTAIASAAARMVSAAGGRPLIEMGSRRTHERAAVAAARAAYIAGFAASSNLAAQRRYGVPAHGTAAHAFTMLHAQHGGPTELAERAAFRAQVEALGPGTTLLVDTYDVTTGVANAVAAAGAELGAIRIDSGELGVLARQAREQLDRLGATRTRIVVSGDLDEFSIAALRGEPVDSYGVGTSLVTGSGAPTANMVYKLVEVDGVPVQKRSSYKESPGGRKEALRRSRATGTITEELVHPAGRPPVIVEPHRVLTLPLVRAGQPVADTSLAAARQLVASGLRSLPADGLKLAPGEPAIPTRTIPA

SEQ ID NO: 11022 - protein, 320 aa, Mycobacterium tuberculosis CDC1551
  misc_feature (61)..(61): Xaa can be any naturally occurring amino acid
MPSLDNTADEKPAIDPILLKVLDAVPFRLSIDDGIEAVRQRLRDLPRQPVHPELRVVDLAXDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 11023 - protein, 229 aa, Mycobacterium tuberculosis CDC1551
MAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 11024 - protein, 1408 aa, Mycobacterium tuberculosis CDC1551
  misc_feature (182)..(182): Xaa can be any naturally occurring amino acid
  misc_feature (227)..(227): Xaa can be any naturally occurring amino acid
  misc_feature (1106)..(1106): Xaa can be any naturally occurring amino acid
MMSLVIVAPETVAAAALDVARIGSSIGAANAAAAGSTTSVLAAGADEVSAAIATLFGSHAREYQAISTQVAAFHDRFAQTLSAAVGSYVSAEATNAAPLATLEHNVLNALNAPTQALLGRPLIGDGAAGAPGTGQAGGAGGILWGNGGAGGSGAPGQVGGAGGAAGLFGTGGAGGAGGAGAXGGAGGSGGWLLGNGGVGGAGGQSLLGGATGGAGGNAGLFGVGGTXGPGGPGGPGGVGGTGGAGGLGGTLYGAGGHGGAGGPGPIGGVGGHGGVGGAAGLLGVGGHGGAGGHGAEGVAGAAGEDLSPHGTSGGVGGDAGDGGTGGRGGWLAGAGGAGGAGGVGGTGGAGGAGFSRALIVAGDNGGDGGNGGMGGAGGAGGPGGAGGLISLLGGQGAGGAGGTGGAGGVGGDGGAGGPGNQAFNAGAGGAGGHGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGASGKGGNGGLVGNGGAGGKGGDGMAGVAGSSPTTAGESGTSGQNGGAGGAGGAGGRGGDFGGDGGTGGAGGNGADGGAGGNGANGANATTPGAKGGDGGHGGPGAQGGNGGQGGPGGLAGNLFGQNGIQGVGGSGGKGGAGGLAGDGGNGANGNFAFGDGNGGHGGNGGNPGAGGQGGSGGAGSTPGAKGAHGFTPTSGGDGGDGGNGGNSQVVGGNGGDGGNGGNGGSAGTGGNGGRGGDGAFGGMSANATNPGENGPNGNPGGNGGAGGAGGAGLNGGNGGAGGNGGLGGFGGNGAAGANGVAVGAPGQPGGAGGHGGAGGNGGAGGNGGQGVVSDGAGGAGGAGGDGGAPGDGANGGNGQGAGAFAGGGGGRGGDGGNAGNAGAGGPGGTGSTAGKAGPAGSIXHDGGNGGHGGHGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGGTGGQGANGGLTGGRGGTGGNGGNGNTGGTGGAGGTGGTGHNGSQPGMGGNGGAGGFGGNGFAGVGGRGGMGGSGGTGGTGDAGPFGTGTGGTGGHGGQGGGGGFSILLGLGGLGGLGSPGSIATGTAGGAGGGGGFGGLGGGEFV

SEQ ID NO: 11025 - protein, 335 aa, Mycobacterium tuberculosis CDC1551
MPGHDSHMHAIEVTETGGPGVLRHVDQPQPQPGHGELLIKAEAIGVNFIDTYFRSGQYPRELPFVIGSEVCGTVEAVGPGVTAADTAISVGDRVVSASANGAYAEFCTAPASLTAKVPDDVTSEVAASALLKGLTAHYLLKSVYPVKRGDTVLVHAGAGGVGLILTQWATHLGVRVITTVSTAEKAKLSKDAGADVVLDYPEDAWQFAGRVRELTGGTGVQAVYDGVGATTFDASLASLAVRGTLALFGAASGPVPPVDPQRLNAAGSVYLTRPSLFHFTRTGEEFSWRAAELFDAIGSEAITVAVGGRYPLADALRAHQDLEARKTVGSVVLLP

SEQ ID NO: 11026 - protein, 375 aa, Mycobacterium tuberculosis CDC1551
MRRCQMSFVVANTEFVSGAAGNLARLGSMISAANSAAAAQTTAVAAAGADEVSAAVAALFGAHGQTYQVLSAQAAAFHSQFVQALSGGAQAYAAAEATNFGPLQPLFDVINAPTLALLNRPLIGNGADGTAANPNGQAGGLLIGNGGNGFSPAAGPGGNGGAAGLLGHGGNGGVGALGANGGAGGTGGWLFGNGGAGGNSGGGGGAGGIGGSAVLFGAGGAGGISPNGMGAGGSGGNGGLFFGNGGAGASSFLGGGGAGGRAFLFGDGGAGGAALSAGSAGRGGDAGFFYGNGGAGGSGAGGASSAHGGAGGQAGLFGNGGEGGDGGALGGNGGNGGNAQLIGNGGDGGDGGGAGAPGLGGRGGLLLGLPGANGT

SEQ ID NO: 11027 - protein, 1011 aa, Mycobacterium tuberculosis CDC1551
MSFLLVEPDLVTAAAANLAGIRSALSEAAAAASTPTTALASAGADEVSAAVSRLFGAYGQQFQALNARAATFHAEFVSLLNGGAAAYTGAEAASVSSMQALLDAVNAPTQTLLGRPLIGNGADGVAGTGSNAGGNGGPGGILYGNGGNGGAGGNGGAAGLIGNGGAGGAGGAGGAGGAGGAGGTGGLLYGNGGAGGNGGSAAAAGGAGGNALLFGNGGNGGSGASGGAAGHAGTIFGNGGNAGAGSGLAGADGGLFGNGGDGGSSTSKAGGAGGNALFGNGGDGGSSTVAAGGAGGNTLVGNGGAGGAGGTSGLTGSGVAGGAGGSVGLWGSGGAGGDGGAATSLLGVGMNAGAGGAGGNAGLLYGNGGAGGAGGNGGDTTVPLFDSGVGGAGGAGGNASLFGNGGTGGVGGKGGTSSDLASATSGAGGAGGAGGVGGLLYGNGGNGGAGGIGGAAINILANAGAGGAGGAAGSSFIGNGGNGGAGGAGGAAALFSSGVGGAGGSGGTALLLGSGGAGGNGGTGGANSGSLFASPGGTGGAGGHGGAGGLIWGNGGAGGNGGNGGTTADGALEGGTGGIGGTGGSAIAFGNGGQGGAGGTGGDHSGGNGIGGKGGASGNGGNAGQVLGDGGTGGTGGAGGAGSGTKAGGTGSDGGHGGNATLIGNGGDGGAGGAGGAGSPAGAPGNGGTGGTGGVLFGQSGSSGPPGAAALAFPSLSSSVPILGPYEDLIANTVANLASIGNTWLADPAPFLQQYLANQFGYGQLTLTALTDATRDFAIGLAGIPPSLQSALQALAAGDVSGAVTDVLGAVVKVFVSGVDASDLSNILLLGPVGDLFPILSIPGAMSQNFTNVVMTVTDTTIAFSIDTTNLTGVMTFGLPLAMTLNAVGSPITTAIAFAESTTAFVSAVQAGNLQAAAAALVGAPANVANGFLNGEARLPLALPTSATGGIPVTVEVPVGGILAPLQPFQATAVIPVIGPVTVTLEGTPAGGIVPALVNYAPTQLAQAIAP

SEQ ID NO: 11028 - protein, 436 aa, Mycobacterium tuberculosis CDC1551
MRTYRTVRYPLGEALLALYRWRGPLINAGVGGHGYTYLLGAEANRFVFANADAFSWSQTFESLVPVDGPTALIVSDGADHRRRRSVVAPGLRHHHVQRYVATMVSNIDTVIDGWQPGQRLDIYQELRSAVRRSTAESLFGQRLAVHSDFLGEQLQPLLDLTRRPPQVMRLQQRVNSPGWRRAMAARKRIDDLIDAQIADARTAPRPDDHMLTTLISGCSEEGTTLSDNEIRDSIVSLITAGYETTSGALAWAIYALLTVPGTWESAASEVARVLGGRVPAADDLSALTYLNGVVHETLRLYSPGVISARRVLRDLWFDGHRIRAGRLLIFSAYVTHRLPEIWPEPTEFRPLRWDPNAADYRKPAPHEFIPFSGGLHRCIGAVMATTEMTVILARLVARAMLQLPAQRTHRIRAANFAALRPWPGLTVEIRKSAPAQ

SEQ ID NO: 11029 - protein, 483 aa, Mycobacterium tuberculosis CDC1551
MSSSESPAGIAQIGVTGLAVMGSNIARNFARHGYTVAVHNRSVAKTDALLKEHSSDGKFVRSETIPEFLAALEKPRRVLIMVKAGEATDAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 11030 - protein, 347 aa, Mycobacterium tuberculosis CDC1551
MMVSPATTATMSAWQVRRPGPMDTGPLERVTTRVPRPAPSELLVAVHACGVCRTDLHVTEGDLPVHRERVIPGHEVVGEVIEVGSAVGAAAGGEFDRGDRVGIAWLRHTCGVCKYCRRGSENLCPQSRYTGWDADGGYAEFTTVPAAFAHHLPSGYSDSELAPLLCAGIIGYRSLLRTELPPGGRLGLYGFGGSAHITAQVALAQGAEIHVMTRGARARKLALQLGAASAQDAADRPPVPLDAAILFAPVGDLVLPALEALDRGGILAIAGIHLTDIPDLNYQQHLFQERQIRSVTSNTRADARAFFDFAAQHHIEVTTPEYPLGQADRALGDLSAGRIAGAAVLLI

SEQ ID NO: 11031 - protein, 408 aa, Mycobacterium tuberculosis CDC1551
MASFLGWTMDAFDYFLVVLVYADIATTFHHTKTDVAFLTTATLAMRPVGALLFGLWADRVGRRVPLMVDVSFYSVIGFLCAFAPNFTVLVILRLLYGIGMGGEWGLGAALSMEKVPAERRGVFSGLLQEGYAFGYLLASVAALVVMNWLGLSWRWLFGLSIIPALISLIIRYRVKESEVWEAAQDRMRLTKTRIRDVLGNPAIVRRFVYLVLLMTAFNWMSHGTQDVYPTFLTATTDHGAGLSSLTARWIVVIYNIGAIIGGLAFGTLSQRFSRRYTIVFCAALGLPIVPLFAYSRTAAMLCLGSFLMQVFVQGAWGVIPAHLTEMSPDAIRGVYPGVTYQLGNLLAAFNLPIQERLAESHGYPFALAATIVPVLLVVAVLTAIGKDATGIRFGTTETAFLVRHRNRH

SEQ ID NO: 11032 - protein, 462 aa, Mycobacterium tuberculosis CDC1551
MIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 11033 - protein, 353 aa, Mycobacterium tuberculosis CDC1551
MKMTYAIVVADATKRYGDFVALDHVDFVVPTGSLTALLGPSGSGKSTLLRTIAGLDQPDTGTITINGRDVTRVPPQRRGIGFVFQHYAAFKHLTVRDNVAFGLKIRKRPKAEIKAKVDNLLQVVGLSGFQSRYPNQLSGGQRQRMALARALAVDPEVLLLDEPFGALDAKVREELRAWLRRLHDEVHVTTVLVTHDQAEALDVADRIAVLHKGRIEQVGSPTDVYDAPANAFVMSFLGAVSTLNGSLVRPHDIRVGRTPNMAVAAADGTAGSTGVLRAVVDRVVVLGFEVRVELTSAATGGAFTAQITRGDAEALALREGDTVYVRATRVPPIAGGVSGVDDAGVERVKVTST

SEQ ID NO: 11034 - protein, 1665 aa, Mycobacterium tuberculosis CDC1551
MGRCEMSYVIATPEMMATAAFDLARIGSQVSAASAVAAMPTTEVVAAGADEVSAGIAALFSAHAQEYQALSAQAAAFHDQFVHTLTAAARWYTATEIANAAAMRVVLGAVNAPTQTLLGRPLIGDGAHGTAPGQPGGAGGLLFGNGGNGAAGAVGQVGGAGGAAGLFGIGGAGGAGGAGAPGGTGGTGGWLAGGGGVGGMGGAGGGAGGAGGNAGLFGNGGAGGAGGAGGGAGGAGGNAGWFGHGGAGGVGGVGAAGANGATPGQDGAAGVAGSDDGAGGDGLAGSDGGDGGAGGVGGNGGRGGWLLGNGGAGGVGGVGGAGGAGAAGGAGGAGATGINGPAGISAAGGDGGAGGNGGAGGNGGVGGAGGAGGSAGLLGYVGRAGDGGAGGGGGLGGAPGDGGAGGNGGSWLAAGDGGAGGHGGDPGLGGAGGAGGASGGAGARAGANGLAAGNDGPVSGGNGGKGGNGAHAPVAGGHGGNGGAGGNGGLVGDGGAGGHGGDGAAGAGYADMTAIFLGSSGTPGEDGGNGGAGGAGGAGGAHAGDGGAGGAGGNGGAGGAGGNGAHGFNAVLVSDGGNGGDGGAGGRGGDGGAGGAGGDAPAGRAGSQGVGGDGGAGGAGGAPGNGGSGGRGDMAFKDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDALALGQPGGNGGQGDAGQAGGAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGIGITVGGAGGAGGNGGDPGAGGRGGLGGDSGNGTSAANGVDASKHGPLTGGDGGVGGNGAKAAAAGGDGGQGGDGGNAGLFGDGGAGGDGADGTAAEALGGDGGAGGAGGKGGDAGDIGDGGDGGKGGDGAHGALGGLTVAGGNGGAGGAGGAGGAGGAFLGDGGNGGAGGQGGAGRGGSPGGGGGVGGHGGAGGDAGMNGGGGTGGQGGNGAAGGAGWSPDSDLKGFDGFDGGSGGAGGDGGAGGAGGTQTGDGGDGGAGGLGGAGGVGGNGVDGFDINETTGRDGGDGGDGGYGGWGGAGGNGGAGGSAPAGEVGNRGVGGDGGDGGSGGDAGNGGLGGDGFTYLADFDGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNVT

SEQ ID NO: 11035 - protein, 505 aa, Mycobacterium tuberculosis CDC1551
MLAAGADEVSQAIARLFSDYATHYQSLNAQAAAFHHSFVQTLNAAGGAYSSAEAANASAQALEQNLLAVINAPAQALFGRPLIGNGANGTAASPNGGDGGILYGNGGNGFSQTTAGVAGGAGGSAGLIGNGGNGGAGGAGAAGGAGGAGGWLLGNGGAGGPGGPTDVPAGTGGAGGAGGDAPLIGWGGNGGPGGFAAFGNGGAGGNGGASGSLFGVGGAGGVGGSSEDVGGTGGAGGAGRGLFLGLGGDGGAGGTSNNNGGDGGAGGTAGGRLFSLGGDGGNGGAGTAIGSNAGDGGAGGDSSALIGYAQGGSGGLGGFGESTGGDGGLGGAGAVLIGTGVGGFGGLGGGSNGTGGAGGAGGTGATLIGLGAGGGGGIGGFAVNVGNGVGGLGGQGGQGAALIGLGAGGAGGAGGATVVGLGGNGGDGGDGGGLFSIGVGGDGGNAGNGAMPANGGNGGNAGVIANGSFAPSFVGFGGNGGNGVNGGTGGSGGILFGANGANGPS

SEQ ID NO: 11036 - protein, 454 aa, Mycobacterium tuberculosis CDC1551
MSFVIAAPEFLTAAAMDLASIGSTVSAASAAASAPTVAILAAGADEVSIAVAALFGMHGQAYQALSVQASAFHQQFVQALTAGAYSYASAEAAAVTPLQQLVDVINAPFRSALGRPLIGNGANGKPGTGQDGGAGGLLYGSGGNGGSGLAGSGQKGGNGGAAGLFGNGGAGGAGASNQAGNGGAGGNGGAGGLIWGTAGTGGNGGFTTFLDAAGGAGGAGGAGGLFGAGGAGGVGGAALGGGAQAAGGNGGAGGVGGLFGAGGAGGAGGTVFGSGGAGGAGGVATVAGHGGHGGNAGLLYGTGGAGGAGGFGGFGGDGGDGGIGGLVGSGGAGGSGGTGTLSGGRGGAGGNAGTFYGSGGAGGAGGESDNGDGGNGGVGGKAGLVGEGGNGGDGGATIAGKGGSGGNGGNAWLTGQGGNGGNAAFGKAGTGSVGVGGAGGLLEGQNGENGLLPS

SEQ ID NO: 11037 - protein, 455 aa, Mycobacterium tuberculosis CDC1551
MSTTQLINPATEEVLASVDHADANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 11038 - protein, 2188 aa, Mycobacterium tuberculosis CDC1551
MTAATPDRRAIITEALHKIDDLTARLEIAEKSSSEPIAVIGMGCRFPGGVNNPEQFWDLLCAGRSGIVRVPAQRWDADAYYCDDHTVPGTICSTEGGFLTSWQPDEFDAEFFSISPREAAAMDPQQRLLIEVAWEALEDAGVPQHTIRGTQTSVFVGVTAYDYMLTLAGRLRPVDLDAYIPTGNSANFAAGRLAYILGARGPAVVIDTACSSSLVAVHLACQSLRGRESDMALVGGTNLLLSPGPSIACSRWGMLSPEGRCKTFDASADGYVRGEGAAVVVLKRLDDAVRDGNRILAVVRGSAVNQDGASSGVTVPNGPAQQALLAKALTSSKLTAADIDYVEAHGTGTPLGDPIELDSLSKVFSDRAGSDQLVIGSVKTNLGHLEAAAGVAGLMKAVLAVHNGYIPRHLNFHQLTPHASEAASRLRIAADGIDWPTTGRPRRAGVSSFGVSGTNAHVVIEQAPDPMAAAGTEPQRGPVPAVSTLVVFGKTAPRVAATASVLADWLDGPGAAVPLADVAHTLNHHRARQTRFGTVAAVDRRQAVIGLRALAAGQSAPGVVAPREGSIGGGTVFVYSGRGSQWAGMGRQLLADEPAFAAAIAELEPEFVAQGGFSLRDVIAGGKELVGIEQIQLGLIGMQLALTALWRSYGVTPDAVIGHSMGEVAAAVVAGALTPAQGLRVTAVRSRLMAPLSGQGTMALLELDAEATEALIADYPEVSLGIYASPRQTVISGPPLLIDELIDKVRQQNGFATRVNIEVAPHNPAMDALQPAMRSELADLTPQPPTIPIISTTYADLGISLGSGPRFDAEHWATNMRNPVRFHQAIAHAGADHHTFIEISAHPLLTHSISDTLRASYDVDNYLRIGTLQRDAHDTLEFHTNLNTTHTTHPPQTPHPPEPHPVLPTTPWQHTQHWITATSAAYHRPDTHPLLGVGVTDPTNGTRVWESELDPDLLWLADHVIDDLVVLPGAAYAEIALAAATDTFAVEQDQPWMISELDLRQMLHVTPGTVLVTTLTGDEQRCQVEIRTRSGSSGWTTHATATVARAEPLAPLDHEGQRREVTTADLEDQLDPDDLYQRLRGAGQQHGPAFQGIVGLAVTQAGVARAQVRLPASARTGSREFMLHPVMMDIALQTLGATRTATDLAGGQDARQGPSSNSALVVPVRFAGVHVYGDITRGVRAVGSLAAAGDRLVGEVVLTDANGQPLLVVDEVEMAVLGSGSGATELTNRLFMLEWEPAPLEKTAEATGALLLIGDPAAGDPLLPALQSSLRDRITDLELASAADEATLRAAISRTSWDGIVVVCPPRANDESMPDEAQLELARTRTLLVASVVETVTRMGARKSPRLWIVTRGAAQFDAGESVTLAQTGLRGIARVLTFEHSELNTTLVDIEPDGTGSLAALAEELLAGSEADEVALRDGQRYVNRLVPAPTTTSGDLAAEARHQVVNLDSSGASRAAVRLQIDQPGRLDALNVHEVKRGRPQGDQVEVRVVAAGLNFSDVLKAMGVYPGLDGAAPVIGGECVGYVTAIGDEVDGVEVGQRVIAFGPGTFGTHLGTIADLVVPIPDTLADNEAATFGVAYLTAWHSLCEVGRLSPGERVLIHSATGGVGMAAVSIAKMIGARIYTTAGSDAKREMLSRLGVEYVGDSRSVDFADEILELTDGYGVDVVLNSLAGEAIQRGVQILAPGGRFIELGKKDVYADASLGLAALAKSASFSVVDLDLNLKLQPARYRQLLQHILQHVADGKLEVLPVTAFSLHDAADAFRLMASGKHTGKIVISIPQHGSIEAIAAPPPLPLVSRDGGYLIVGGMGGLGFVVARWLAEQGAGLIVLNGRSAPSDEVAAAIAELNASGSRIEVITGDITEPDTAERLVRAVEDAGFRLAGVVHSAMVLADEIVLNMTDSAARRVFAPKVTGSWRLHVATAARDVDWWLTFSSAAALLGTPGQGAYAAANSWVDGLVAHRRSAGLPAVGINWGPWADVGRAQFFKDLGVEMINAEQGLAAMQAVLTADRGRTGVFSLDARQWFQSFPAVAGSSLFAKLHDSAARKSGQRRGGGAIRAQLDALDAAERPGHLASAIADEIRAVLRSGDPIDHHRPLETLGLDSLMGLELRNRLEASLGITLPVALVWAYPTISDLATALCERMDYATPAAAQEISDTEPELSDEEMDLLADLVDASELEAATRGES

SEQ ID NO: 11039 - protein, 309 aa, Mycobacterium tuberculosis CDC1551
MLSTSRIFGVDGLAVDDDIVASRAHMRAICEAMPGPQIHVDVTDLSIPGPAGEIPARHYRPSGGGATPLLVFYHGGGWTLGDLDTHDALCRLTCRDADIQVLSIDYRLAPEHPAPAAVEDAYAAFVWAHEHASDEFGALPGRVAVGGDSAGGNLSAVVCQLARDKARYEGGPTPVLQWLLYPRTDFTAQTRSMGLFGNGFLLTKRDIDWFHTQYLRDSDVDPADPRLSPLLAESLSGLAPALIAVAGFDPLRDEGESYAKALRAAGTAVDLRYLGSLTHGFLNLFQLGGGSAAGTNELISALRAHLSRV

SEQ ID NO: 11040 - protein, 471 aa, Mycobacterium tuberculosis CDC1551
MVTRIVILGGGPAGYEAALVAATSHPETTQVTVIDCDGIGGAAVLDDCVPSKTFIASTGLRTELRRAPHLGFHIDFDDAKISLPQIHARVKTLAAAQSADITAQLLSMGVQVIAGRGELIDSTPGLARHRIKATAADGSTSEHEADVVLVATGASPRILPSAQPDGERILTWRQLYDLDALPDHLIVVGSGVTGAEFVDAYTELGVPVTVVASQDHVLPYEDADAALVLEESFAERGVRLFKNARAASVTRTGAGVLVTMTDGRTVEGSHALMTIGSVPNTSGLGLERVGIQLGRGNYLTVDRVSRTLATGIYAAGDCTGLLPLASVAAMQGRIAMYHALGEGVSPIRLRTVAATVFTRPEIAAVGVPQSVIDAGSVAARTIMLPLRTNARAKMSEMRHGFVKIFCRRSTGVVIGGVVVAPIASELILPIAVAVQNRITVNELAQTLAVYPSLSGSITEAARRLMAHDDLD

SEQ ID NO: 11041 - protein, 466 aa, Mycobacterium tuberculosis CDC1551
MPRIRKPPSRSLPEPSAALANTTTRNLWLHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 11042 - protein, 500 aa, Mycobacterium tuberculosis CDC1551
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPIPPAGICSRAGSPTRVAAADPAGRDIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 11043 - protein, 338 aa, Mycobacterium tuberculosis CDC1551
MLGGKGGDGGNGDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFFGGKGGFGGDGGQGGPNGGGTVGTVAGGGGNGGVGGRGGDGVFAGAGGQGGLGGQGGNGGGSTGGNGGLGGAGGGGGNAPDGGFGGNGGKGGQGGIGGGTQSATGLGGDGGDGGDGGNGGNSGAKAGGAGGKGQAGQPNSGTEPGFGGDGGLGGAGATP

SEQ ID NO: 11044 - protein, 1507 aa, Mycobacterium tuberculosis CDC1551
MVMSLMVAPELVAAAAADLTGIGQAISAANAAAAGPTTQVLAAAGDEVSAAIAALFGTHAQEYQALSARVATFHEQFVRSLTAAGSAYATAEAANASPLQALEQQVLGAINAPTQLWLGRPLIGDGVHGAPGTGQPGGAGGLLWGNGGNGGSGAAGQVGGPGGAAGLFGNGGSGGSGGAGAAGGVGGSGGWLNGNGGAGGAGGTGANGGAGGNAWLFGAGGSGGAGTNGGVGGSGGFVYGNGGAGGIGGIGGIGGNGGDAGLFGNGGAGGAGAAGLPGAAGLNGGDGSDGGNGGTGGNGGRGGLLVGNGGAGGAGGVGGDGGKGGAGDPSFAVNNGAGGNGGHGGNPGVGGAGGAGGLLAGAHGAAGATPTSGGNGGDGGIGATANSPLQAGGAGGNGGHGGLVGNGGTGGAGGAGHAGSTGATGTALQPTGGNGTNGGAGGHGGNGGNGGAQHGDGGVGGKGGAGGSGGAGGNGFDAATLGSPGADGGMGGNGGKGGDGGGGGAGGTAVAGTAGKAGDGGAGGDGGKAGDGGAGAAGDVTLAVNQGAGGDGGNGGEVGVGGKGGAGGVSANPALNGSAGANGTAPTSGGNGGNGGAGATPTVAGENGGAGGNGGHGGSVGNGGAGGAGGNGVAGTGLALNGGNGGNGGIGGNGGSAAGTGGDGGKGGNGGAGANGQDFSASANGANGGQGGNGGNGGIGGKGGDAFATFAKAGNGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGTGGAGGAGGTLAGHGGNGGKGGNGGQGGIGGAGERGADGAGPNANGANGENGGSGGNGGDGGAGGNGGAGRKAQAAGYTDGATGTGGDGGNGGDGGKAGDGGAGENGLNSGAMLPGGGTVGNPGTGGNGGNGGNAGVGGTGGKAGTGSLTGLDGTDGITPNGGNGGAGMINGGLGGFGGAGGGGAVDVAATTGGAGGNGGAGGFASTGLGGPGGAGGPGGAGDFASGVGGVGGAGGDGGAGGVGGFGGQGGIGGEGRTGGNGGSGGDGGGGISLGGNGGLGGNGGVSETGFGGAGGNGGYGGPGGPEGNGGLGGNGGAGGNGGVSTTGGDGGAGGKGGNGGDGGNVGLGGDAGSGGAGGNGGIGTDAGGAGGAGGAGGNGGSSKSTTTGNAGSGGAGGNGGTGLNGAGGAGGAGGNAGVAGVSFGNAVGGDGGNGGNGGHGGDGTTGGAGGKGGNGSSGAASGSGVVNVTAGHGGNGGNGGNGGNGSAGAGGQGGAGGSAGHGGNGGGATGGDGGNGGNGGNSGNSTGVAGLAGGAAGAGGNGGGTSSAAGHGGSGGNGGSGGSGGSGTTGGAGAAGGNGGAGAGGGSLSTGQSGGPRRQRWCRWQRRRWLGRQRRRRWCRWQRRCRRQRWRWRCRQRRLRRQWRQGRRRCRPWLHRRRGRQGRRWRQRRFQQRQRSRWQRR

SEQ ID NO: 11045 - protein, 1384 aa, Mycobacterium tuberculosis CDC1551
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGAAGAGGAAGARGALTSGGLAGGVGAGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNAGAGGNGGSGDFGGNTTSGASGSGGNGGNAGTAGSGGAGGTGGTGLSGGNGGNGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGDGGNGGTGVIAGGGGTGGNGGASGAGGAGGTGGFAGNGNAGGNGGTGGASEDGDNGNAGSGATGGTGGNGGTGGDGGAAGLGGVA

SEQ ID NO: 11046 - protein, 1715 aa, Mycobacterium tuberculosis CDC1551
MPRWPRRPVGSSPMSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVSGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGAGADATATGATGGTGFAGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGAGGSAGAGGINGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGASGLGLGLSGFDGGQGGQGGAGGNAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGAPATLIGGPDGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGEGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 11047 - protein, 1217 aa, Mycobacterium tuberculosis CDC1551
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGMGGAGGAGADNPTGIGGTGGDGGTGGSAGEGGAGGAAGQLFSASGAAGNAGVGGAGGQGGDGGAGGAGADADQPGATGGTGFAGGAGGAGGAGGSSGAGGTNGSGGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGAGGNSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGAGGSSGAGGTNGSGGAGGTGGQGGAGGAGISFSNGSNGGTGGTGGVGGTGGDGGNAGTGAGDPGKGGTGGTGGTGGSGGAGGSGGANFNGGTGGTGGTGGTGGKGGLNTDGLSSATSGTGGTGGTGGKGGTGGAGDDSAGGTGGTGGAGGNAGAGGLANTGGTAGNAGIGGDGGQGGNGGQGDSGSGLGGQPGFAGGPGGKGGAGGNAGTGGTNGSGAGGAGGQGGAGGAGISFSNGSNGGTGGTGGVGGTGGDGGNAGTGAGDPGKGGTGGTGGTGGSGGAGGSGGANFNGGTGGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNGS

SEQ ID NO: 11048 - protein, 436 aa, Mycobacterium tuberculosis CDC1551
MSFVIAVPEFLSAAATDLANLGSTISAANAAASIPTTGVLAAGADDVSAAIAALFGAHAQAYQTISAQAATFHAQFVQTLSAGAGAYANAEAANVQQSLLNAINAPTQALLGRPLIGDGADGTAPGQNGGAGGLLYGNGGNGAAGVNAGIAGGSGGAAGLIGNGGSGGAGGAGAAGGSGGQGGLLYGNGGAGGNGGAATIPGGNGGAGGAGGNAWLFGNGGAGGLGAAGAAGAAGVNPLTVPAGQGSMGNNGEPGGPGQPGTEFGQTGGTGGTGGTGLSVGGTGGTGGTGGTGGAGGSGGRGGLLVGDGGAGGIGGTGGEGGIGARGGTGGQGGMGGAGQPGVGGDAGDGGNGGIGGDGGAGGDGGAGGAGGLFGVSGSSGLGGAAGSGGNGGGGGEPGVAGSPGVGPAGRGGDGNLGQFGPEGAPGQPGQPGQPG

SEQ ID NO: 11049 - protein, 202 aa, Mycobacterium tuberculosis CDC1551
MHVTQSSSAITPGQTAELYPGDIKSVLLTAEQIQARIAELGEQIGNDYRELSATTGQDLLMITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPNDFVVGYGLDYDERYRDLSYIGTLDPRVYQ

SEQ ID NO: 11050 - protein, 368 aa, Mycobacterium tuberculosis CDC1551
MSGGACIAVRSLSRSWTDNAIRLIEADARRSADTHLLRYPLPAAWCTDVDVELYLKDETTHITGSLKHRLARSLFLYALCNGWINENTTVVEASSGSTAVSEAYFAALLGLPFIAVMPAATSASKIALIESQGGRCHFVQNSSQVYAEAERVAKETGGHYLDQFTNAERATDWRGNNNIAESIYVQMREEKHPTPEWIVVGAGTGGTSATIGRYIRYRRHATRLCVVDPENSAFFPAYSEGRYDIVMPTSSRIEGIGRPRVEPSFLPGVVDRMVAVPDAASIAAARHVSAVLGRRVGPSTGTNLWGAFGLLAEMVKQGRSGSVVTLLADSGDRYADTYFSDEWVSAQGLDPAGPAAALVEFERSCRWT

SEQ ID NO: 11051 - protein, 475 aa, Anthoceros formosae
MSPQTETKAGVGFKAGVKDYRLTYYTPDYETKDTDILAAFRMTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIFKSQAETGEIKGHYLNATAGTCEEMMKRAHFARELGMPIVMHDYLTGGFTANTTLARYCRDNGLLLHIHRAMHAVIDRQRNHGIHFRVLAKALRMSGGDHIHSGTVVGKLEGEREVTLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNDIIREASKWSPELAAACEVWKEIKFVFETIDTL

SEQ ID NO: 11052 - protein, 165 aa, Bacillus subtilis
MNSVDLTADSQALLTCPNVRHNLSAAQLTEKVLSRNEGILTSTGAVRATTGAYTGRSPKDKFIVEEESTKNKIDWGPVNQPISEEAFERLYTKVVSYLKERDELFVFEGFAGADEKYRLPITVVNEFAWHNLFARQLFIRPEGNDKKTVEQPFTILSAPHFKADP

SEQ ID NO: 11053 - protein, 504 aa, Ipomoea batatas
MGRKYLCNAFLLWAVVCTALPAAYSDNNLLRVGLKKRPLDLESIKAAKGARLGGKYGKGVNKKLGDSDEGIVSLNNYLDAQYYGEISIGSPPQNFTVIFDTGSSNLWVPSSKCYLSIACYFHSKYKSSKSSTYTQIGKSCSITYGSVSISGFLSQDDVQLGDLLVKDQVFIETTREPSLTFIIAKFDGILGLGFQEISVENVVPVWYDMVEQGLVDEPVFSFWLNRDPKAEVGGELVFGGVDPKHFKGEHTYVPVTQKGYWQIDLGDFLIGNSSTGYCEGGCAVIVDSGTSLLTGPTAVVTEINYAIGPEGVVCAECKEVVSEYGEMIWDLLVSGLRADQVCSELGLCFLNGAWHESSIIKTVVEKEAEGNLTSNPLCTTCEMAVIWLQNQLKQKGIKEKVFEYVDQLCEKLPSPDGESVIDCNSISSMPNVTFVIGDKDFVLTPEQYILKTGEGIAAVCVSGFLALDVPPPQGPLWILGDVFMGAYHTVFDYGNLQVGFAEAA

SEQ ID NO: 11054 - protein, 487 aa, Chlorobaculum tepidum
MSIAADSGGDALHTTSYVMQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 11055 - protein, 379 aa, Hordeum vulgare subsp. vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGICTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 11056 - protein, 166 aa, Brassica rapa
  misc_feature (53)..(53): Xaa can be any naturally occurring amino acid
  misc_feature (78)..(78): Xaa can be any naturally occurring amino acid
KDFREYADFVFQEYGDKVKHWITFNEPWVFAHAGYDVGKKAPGRCSDYVDPTXKGGRSGYEVYLVSHNLLNAHAEAFXAFTQCEKCKGGKVGIAHSPAWFEPHDFQDSQDGASIGRALDFMLGWHLDTTMYGDYPQIMKDIVGHRLPQFTAAQKAKLRHSAHFVGF

SEQ ID NO: 11057 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 11058 - protein, 301 aa, Pseudomonas putida
MSRTIRFHKFGSGRGASNAKSIAACSSTVPWRSARCVSRQSAISWYDTLWRQNLASSQARLPSGLGHEMAGVVTAVGADVDDLSVGDKVASFPAESPNDYPVYGESIVLPRTALTRYPDVLSPIEASVHYTPLLIAYFAYADLARVKPGQFALVTDASHCAGPSFVQLGKALGVRVIAATKSAEEREYLLSLGAEKVIVTEEEDLLMRINKITDNRGVDVVFDGLGGPQMSLLGRCVGATPQVWCCTACRVVTRLRSRRVQRFRRTFSSLCTASATSPASRSWALSRTTSLCSVLCATSTS

SEQ ID NO: 11059 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKGYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 11060 - protein, 388 aa, Nicotiana attenuata
MEVISTNTNGSTIFKNGAIPMNGYQNGTSKHQNGHQNGTSEHRNGHQNGISEHQNGHKNGTSEHQNGHQNGTSEQQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNFDIHKAAFILPSFARSMIES

SEQ ID NO: 11061 - protein, 371 aa, Nicotiana attenuata
MEVISTNTNGSTIFKNGAIPMNGHQNGTSKHQNGTSEHPNGHQNGTSEHQNGHQNGTSEQQNGTISHDNGNKLVGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKPKLAPLKFYNSDIHKAAFILPSFARSMIES

SEQ ID NO: 11062 - protein, 400 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 11063 - protein, 400 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRVEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 11064 - protein, 446 aa, Pseudomonas sp. ADP
MPTPMERVDRFFELSSRGTTVQRELLAAVTTFATMSYILVVHPLIMSDAGMDRAQVLTITAVVAGVFSILMGLMANLPIAVAPGMGANGLVAYTLILGLGVPWQGALGLVFWSGVVFLVLTLTGIRRLLLDAFPDALRRALTAGIGLFIMFIGLKTAGIVVAAPAPSLVQIGVVTAPTVLLALSGIPIVMGLMARRVPGAIILTIILLTAIGFFIPTATGSLTPMPSAALAQPTGFGDLWLALDFGYLWSHLGIALPAMLSLVFMDLFSSLAAMNALCQRAGLVDDQGAMLKPTEALSADAMAAIGASLAGTSTAICFGESAAGIESGGRTGLVAIFVGLFFFLALYLNPLILIIPAEASAPALVFIGLLMFVEVARIDFSDVITGGAATLTLILMAVTSISDGMAIGLIVYAIAMVITGRARQVHPIAYGLAVVLGAYYVLLPPL

SEQ ID NO: 11065 - protein, 418 aa, Pseudomonas sp. ADP
MLALRTVTYCTENEETPPWPKCARSPPFAATVPLSAPTTSKWKKPPARARRRRAPRRSSPSSAPSSPLAARPCACRSCPTTQRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFGIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 11066 - protein, 499 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAATPRISSPGVIFHAATGIDAATVAPVQTTLQKRILRAMGGGRSGHRQDHPPASDAGREHRHGGGSGAWQLHGCAACAQVSPQPSYPDKARTGDGSGLVLCVPKQSPQNTVHLYSIHVSHFQAQALQPTPPRTHAAVPNGSRALRDLARVGQRGSVRRPGRPPHPQALRAQSVCQVS

SEQ ID NO: 11067 - protein, 500 aa, Acinetobacter sp. YAA
MSEKLDFITKNNLWTDKQRDAADKVLAEIDSLGLEMIRLSWADQYGLLRGKALSVAALKAAFSEGSEVTMAPFSFNLVSEWVFNPFTAGGGFGIDEFDELGGVPSVVMVPDPTTFKVLPWADKTGWMLADLHWKSGEPFPLCPRGIMKKAVKSLSDEGYLFKCGIELEWYLTKIVDRSLSPESLGAPGVQPDAIQVQPVAQGYSYLLEYHLDQVDDIMSKVRKGLLELNLPLRSIEDELAPSQMETTFDVMEGLEAADAALLIKSAIKQICSRHGYHATFMCKPAINGFSVASGWHMHQSLVDKDTRKNLFIPSEGEVVSPLGRAYAGGLLANGSAASSFTTPTVNGYRRRQPHSLAPDRRAWAKENKAAMVRVISATGDPASRIENRIGEPGANPYLYMASQIVSGLDGIKIKRDPGGLQGAPYGAQVPMLPTALAEALDALEHDSELFRSCFGDTFIKYWLQLRRSEWARFLDAEGAEAAEPTGAVTQWEQKEYFNLL

SEQ ID NO: 11068 - protein, 396 aa, Rhodococcus sp. NCIMB 9784
MTMAQPSNDIVIVGGGLAAVRTAQGLRTLGYDGPIRLYSNESEPPYDRPPLSKDFLTGELDTDGLHLLHDKALARLDLDIHLDSEVVALDPAGRRLALADGTTVPYGRLVVATGAQARRLPGLSPSARIHYLRTVDDARALRTALADASRITVVGTGFIGLEVASSARHLGLEVDVVAADEGPMIGIVGRRLSQWLTELHTAHGVRLTNSVVVSSVDESATGVTLTLDDGTSRSSDIVAVGVGVGRELQWLREAGLEVDRGLVCDVDGRTSDPFVFGVGDIVCMHIGPEHEDLQHWTAAADSARRTAHALMEAEHSHDPGDGFFWTEQHGHRLQFVGAGGTDAEVDVLSGSIDEGKFVAHLRCGSTVTGVFASNSPREFLEARLAFQKQAAAGAVG

SEQ ID NO: 11069 - protein, 355 aa, Pisum sativum
ARELDGTIIAPTNPSAWSGVTLQWLEFTKLEGIVIQGNGVIDGRGSVWWQDFPYDNPIDDEEKLIIPLNHTQNPPMPVQNEMGRTMPSNKPTALRFYGSYGPTVTGITIQNSPQCHLKFDSCNRVLVHDVSISSPGDSPNTDGIHLQNSKDVLIYSSKLACGDDCISIQTGCSNVYVHNVDCGPGHGISIGSLGKDNTRACVSNITVRDVNIHNSMNGVRIKTWQGGSGSVQGVLFSNIQVTEVQLPIVIDQFYCDKRTCTNHTSAVSLEGINYERIKGTYTVKPVHFACSDSFPCVDVSLATVELKPIQEQYHLYDPFCWQTFGELKTPTVPPIGCLQIGKPTNNRIQTDHDIC

SEQ ID NO: 11070 - protein, 214 aa, Paeonia cambessedesii
  misc_feature (146)..(146): Xaa can be any naturally occurring amino acid
  misc_feature (150)..(150): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGXSRIXGVDLNPKRFEEAKKFGVTEFVNPKDYNKPVQEVIAEMTGGGVDRSVECTGSIMAMISAFECVHD

SEQ ID NO: 11071 - protein, 214 aa, Paeonia peregrina
  misc_feature (151)..(151): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVTIFGLGAVGLAAAEGARIAGASRIIXVDLNPKRFEEAKKFGVTEFVNPKDYNKPVQEVIAEMTGGGVDRSVECTGSIMAMISAFECVHD

SEQ ID NO: 11072 - protein, 214 aa, Paeonia peregrina
  misc_feature (145)..(145): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGPRIAXASRIIGVDLNPKRFEEAKKFGVTEFVNPKDYNKPVQEVIAEMTGGGVDRSVECTGSIMAMISAFECVHD

SEQ ID NO: 11073 - protein, 214 aa, Paeonia peregrina
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNTPVQEVIAEMTGGGVDRSVECTGSIMAMISAFECVHD

SEQ ID NO: 11074 - protein, 214 aa, Paeonia officinalis
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 11075 - protein, 214 aa, Paeonia officinalis
  misc_feature (145)..(145): Xaa can be any naturally occurring amino acid
  misc_feature (158)..(158): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGPRIAXASRIIGVDLNPKXFEEAKKFGVTEFVNPKDYNKPVQEVIAEMTDGGVDRSVECTGSIMAMISAFECVHD

SEQ ID NO: 11076 - protein, 214 aa, Paeonia officinalis
IVESVGEGVTDVKPGDHVLPIFTGECKECRHCKSEESNLCDLLRINTDRGVMLNDGKSRFSFNGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11077 - protein, 214 aa, Paeonia officinalis
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTDGGVDRSVECTGSIMAMMSAFECVHD

SEQ ID NO: 11078 - protein, 214 aa, Paeonia officinalis
  misc_feature (145)..(145): Xaa can be any naturally occurring amino acid
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLSVAKPKKGSTVAIFGLGAVGLAAAEGARIAXASRIIGVDLNPKRFDEARKFGVTEFVNPKDYNKPVQEVIAEMTGGGVDRSVECTGSIMAMMSAFECVHD

SEQ ID NO: 11079 - protein, 214 aa, Paeonia officinalis
IVESVGEGVTDVKPGDHVLPIFTGECKECRHCKSEESNMCDLLRINTDRGVMLNDGQSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11080 - protein, 214 aa, Paeonia cambessedesii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKNYNKPVQEVIAEMTGGGVDRSVECTGSIMAMMSAFGCIHD

SEQ ID NO: 11081 - protein, 214 aa, Paeonia mlokosewitschi
IVESVGEGVTDVKPGDHVFPIFTGECKECRHCKSEESNMCDLLRINTDRGVMLNDGQSRFSINGQPIFHFVGTSTFSEYTVLHVGCLAKINEEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11082 - protein, 214 aa, Paeonia mlokosewitschi
IVESVGEGVTDVKPGDHVLPIFTGECKECRHCKSEESNMCDLLRINTDRGVMLNDGKSRFSINGQPIFHFVGTSTFSEYTVLHVGCLAKINEEAPPDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11083 - protein, 214 aa, Paeonia peregrina
  misc_feature (145)..(145): Xaa can be any naturally occurring amino acid
  misc_feature (151)..(151): Xaa can be any naturally occurring amino acid
IVESVGEGVTDVKPGDHVLPIFTGECKECRHCKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAXASRIIXVDLNPKRFDEARKFGVTEFVNPKDYNKPVQEVIAEMTGGGVDRSVKCTGSIMAMMSTFECVHD

SEQ ID NO: 11084 - protein, 214 aa, Paeonia peregrina
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATFNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11085 - protein, 214 aa, Paeonia peregrina
IVESVGKGVTDVKPGDHVLPIFTGECKECRHCKSEESNMCDLLRINTDRGVMLNDDKSRFSINGQPIFHFVGTSTFSEYTVLHFGCLAKINPEAPLDKVCVLSRGISTGLGATLNVAKPKKGSIVAIFGLGAVGLAAAEGARIAGASRIIGVDLNPKRFDEARKFGVTEFVNPKDYNKPIQEVIAEMTGGGVDRSVECTGSIMAMMSAFECVHD

SEQ ID NO: 11086 - protein, 214 aa, Paeonia peregrina
IVESVGKGVTDVKPGDHVLPIFTGEYKECRHCKSEESNMCDLLRINTDRGVMLNDGKSRFSINGQPIFHFVGTSTFSEYTVLHFGCLAKINPEAPLDKVCVLSRGISTGLGATLNVAKPKKGSIVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11087 - protein, 174 aa, Paeonia peregrina
  misc_feature (77)..(77): Xaa can be any naturally occurring amino acid
DLLRINTDRGVMLNDGKSRFSINGQPIFHFVGTSTFSEYTVLHVGCLAKINEEAPLDKVCVLSCGISTGLGATLNVXKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11088 - protein, 174 aa, Paeonia peregrina
DLLRINTDRGVMLNDGKSRFSINGQPIFHFVGTSTFSEYTVLHVGCLAKINEEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 11089 - protein, 509 aa, Pseudomonas syringae pv. glycinea
MSLISEFRSVVAQQPDTTAVVEDQRAFSFTELAQLADKVSAGLLQAGLQPGDRVAIHLGNRLELVALYYACLEIGAVTVPINRRLVAGEIEHLLHHSGARYYIGEQETYSRYAAVIAGSATLERAWIVAGEEALKGERYLPWSDLLVSSPSKRPPSHADSLAAIFYTSGTTGITKGIVHSQATLAQAVALMKAMMPPRTAQGALDTGAVHSMMDAIVPWSILMILAAHRLGRAVVLLPVLTAETTLALLQRLPLSFLKGAPSHFNNLLAAGEASAAPPLPSLTSTYSVSGGDLCPPKLGRRWHDLWGGTLRGSYGTTESGPIFCQPDVAGTEQSSIGWPLPGVALQQTETGELLIRSPANTPGLWNGQDADRLPATRWIATGDLVQRQDDGGYLIIGREKDMLKCDAYSISPVEVEQELLKLLDIAEAVVFGVPDATIGERPVALLRTTSGRELPTQQLKQHLKALIAEYKHPRQYLFVERIPLSSAGKVSRKQLASDYREILGAAPST

SEQ ID NO: 11090 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 11091 - protein, 484 aa, Alcanivorax borkumensis
MKIANLAEVGATNAPTADTIDSVFSALQRAQLARRASFTLDVRIAQLNKLRDSLKRHESNIIAACAADFKKPAPEVKLTELLPVLQEIRHAKKHLRKWMRPKWAPASIGVLGTKSHVRPEPKGVCLIIAPWNYPLNLALGPLVSALAAGNSVIIKPSEMTPHTSKVIANIVAETFPPDLVSVIEGDAAVSQKLLALPFDHIFFTGSPAVGKVVMEAAAKNLCSVTLELGGKSPTVVGPNANIKKAARNIVWGKFANNGQTCIAPDHVFVHSNIAAQFNQALQKEIGRVYGKTLEAQKSTADYCRIVNRRHFQRISNLIDDAKSKGAKIFEGGAIDTDQNFIAPTLISNVSNDMDITREELFGPILPIIEYDDIDSVIEQINDNPKPLALYIFDEDKSFAKHIVEQTSSGAVGINLTVVHFLHPNLPFGGVNHSGIGAAHGEYGFRSFSHDKVLMEDRHSLIHLLFPPYTGWVRQLINAAVRILG

SEQ ID NO: 11092 - protein, 439 aa, Emericella nidulans
MSASSTLKKAFPQVDAEGHNLPPSPAPSSPHGSRRYNIATELVYTESNDQYNASSVPIYQSATFKQSSHEGGGEYDYTRSGNPTRTHLERHLAKIMSTQRALVVSSGMAALDVITRLLRPGDEVVTGDDLYGGTNRLLKYLSTNGGIIVHHVDTTNPDKVKEVLTDKTAMVLLETPTNPLIKIVDIPTIAAASHEANPNCLVIVDNTMMSPLLLSPLELGADVVYESGTKYLSGHHDVMAGVIAVNDPALGERLYFPINASGCGLSPFDSWLLMRGVKTLKVRMDQQQANAQRIAEFLESHGFKVRYPGLRSHPQYELHHSMARGAGAVLSFETGDVSVSERIVANASVGYQRYFGCVNTLISLPCRMSHASIDAETRKERAMPEDLIRLCVGIEDVDDLIDDLSERWYKLALSTSLWTALKRTRRSQRSQVMKEYGYG

SEQ ID NO: 11093 - protein, 279 aa, Pseudomonas aeruginosa
MTTAAPTPSLFGQCLSEFLGTALLIFFGAGCVAALKVAGASFGLWEISIIWGVGVSMAIYLSAGVSGAHLNPAVSIALWLFAGFEGRKLPFYITAQVAGAFCAAALVYTLYSSLFIEFEQAQNIVRGSQDSLALASVFSTYPHPALSVGQAFLVEVVITAILMAVIMALTDDGNGLPRGPLAPLLIGLLIAVIGSAMGPLTGFAMNPARDFGPKLMTYLAGWGPIAFTGGREIPYFLVPIFAPILGACLGAGGYRVLIARHLPSAAAPAEAEPEKVRAS

SEQ ID NO: 11094 - protein, 165 aa, Oryza sativa
MEHQGQHGHVTSRVDEYGNPVGTGAGHGQMGTAGMGTHGTAGTGGGQFQPMREEHKTGGVLQRSGSSSSSSSEDDGMGRTTKKRDLGEDLGETPRRATRANSSMPWGGTGTGTGTGTGTGGAYGQQGHGTGMTTGTTGAHGTTTTDTGEKKGIMDKIKEKLPGQH

SEQ ID NO: 11095 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 11096 - protein, 172 aa, Phaseolus vulgaris
HVYKGYIDGGSTPVAIKRLKPDSQQAGREFLNEIRMLSQLRHRNIVSLIGYCNDNREMILVYDFMTRGNLRDHLYNTDNPAISWKQRLQICIEAARGLHYLHTGKQHMIIHRDVKSTNILLDDKWEAKVSDFGLSRLGPIGTSKAHVSTDVRGSFGYLDPEYYKRYRLTEKS

SEQ ID NO: 11097 - protein, 172 aa, Phaseolus vulgaris
HVYKGYIDDGSTPVAIKRLKPDSQQGGREFLNEIEMLSQLRHRNIVSLIGYCNDNREMILVYDFMTRGNLRDHLYNTDNPAISWKQRLQICIEAARGLHYLHTGAKHMIIHRDVKSTNVLLDDKWEAKVSDFGLSRLGPIGTSKAHVSTDVRGSFGYLDPEYYKRYRLTEKS

SEQ ID NO: 11098 - protein, 172 aa, Phaseolus vulgaris
NVYKGYIDDGSTPVAIKRLKSDSQQGLKEFMNEIEMLSQLRHLHLVSLIGYCYESNEMILVYHFMDRGTLRDHLYYTDNPSLPWKQRVEICIGVARGLHYLHTGVKQVIIHRGVKSSNILLDEKWVAKVSDFGLSRIGPTGISMSHVNTQVKGSIGYLDPEYYKRQRLTEKS

SEQ ID NO: 11099 - protein, 172 aa, Phaseolus vulgaris
HVYKGYIDGGSTPVAIKRLKPESQQGAHEFMNEIEMLSQLRHLHLVSLIGYCNEMNEMILVYDFMERGTLRDHLYNTDNPAISWKQRLRICIGAARGLHYLHSGAKHTIIHRDVKSTNILLDEKWVAKVSDFGLSRFGPTGMDKSHVSTHVKGSFGYIDPDYYKRHRVTEKS

SEQ ID NO: 11100 - protein, 172 aa, Phaseolus vulgaris
HVYKGYIDGGSTPVAIKRLKPESQQGAHEFMNEIEMLSQLRHLHLVSLIGYCNEMNEMILVYDFMERGTLRDHLYNTDNPAITWKQRLQICIGAARGLHYLHSGAKHTIIHRDVKSTNILLDDKWVAKVSDFGLSRFGPTGMDKSHVSTHVKGSFGYIDPEYYKRHRVTEKS

SEQ ID NO: 11101 - protein, 172 aa, Phaseolus vulgaris
HVYKGYIDGGSTPVAIKRLKPDSQQGGREFLNEIRMLSQLRHRNIVSLIGYCNDNREMILVYDFMTRGNLRDHLYNTDNPAISWKQRLQICIEAARGLHYLHTGKQHMIIHRDVKSTNILLDDKWEAKVSDFGLSRLGPIGTSKAHVSTDVRGSFGYLDPEYYKRYRLTEKS

SEQ ID NO: 11102 - protein, 172 aa, Phaseolus vulgaris
NVYKGYIDDGSTPVAIKRLKSDSQQGLKEFMNEIEMLSQLRHLHLVSLIGYCYESNEMILVYHFMDRGTLRDHLYYTDNPSLPWKQRVEICIGVARGLHYLHTGVKQVIIHRDVKSSNILLDEKWVAKVSDFGLSRIGPTGISMSHVNTQVKGSIGYLDPEYYKRQRLTEKS

SEQ ID NO: 11103 - protein, 310 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLSRDQIIADGLLCKNKGTLQEIIDPSIKDQIDQNSLRKFSETVEKCLQADGPDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 11104 - protein, 231 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLPRDQINLAGWGLLCKNKGTLQEIIDPSIKDQIDQNSLRKFSETVEKCLQEDGLTNHG

SEQ ID NO: 11105 - protein, 312 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLPRDQINLAGWGLLCKNKGTLQEIIDPSIKDQNDHNSLRKFSVTVEKCLQEDGSDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 11106 - protein, 312 aa, Phaseolus vulgaris
PGSGQGLPEFQTEIMVLSKIRHRHLVSLIGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAAIDPSLPRDQINLVEWGLLCKNKGTLQEIIDPSIKDQIDQNSLRKFSETIEKCLQEDGSDRPTMGDVLWDLEYAVQLQRGANAIQREPYEDSSSSVSASFQLPNVRRLPSLSTLSEADDTIVRNDESDSAVDYVLSQLKIDDAR

SEQ ID NO: 11107 - protein, 312 aa, Phaseolus vulgaris
PGSGQGLPEFQTEIMVLSKIRHRHLVSLIGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAAIDPSLPRDQINLVEWGLLCKNKGTLQEIIDPSIKDQIDQNSLRKSSETIEKCLQEDGSDRPTMGDVLWDLEYGVQLQRGANAIQREPYEDSSSSVSASFHLPNVRRLPSLSTLSEADDTIVRNDESDSAVDYVFSQLKIDDAR

SEQ ID NO: 11108 - protein, 312 aa, Phaseolus vulgaris
PGSGQGLPEFQTEIMVLSKIRHRHLVSLTGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLWQVLCARAAIDPSLPRDQINLVWWGLLCKNKGTLQEIIDPSIKDQIDQNSLRKFSETIEKCLQEDGSDRPTMGDVLWDLEYAVQLQRGANAIQREPYEGSSSSVSASFQLPNVRRLPSLSTLSEADDTIVRNDESDSAVDYVFSQLKIDDAR

SEQ ID NO: 11109 - protein, 312 aa, Phaseolus vulgaris
PGSGQGLPEFQTEIMVLSKIRHRHLVSLTGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAVIEPSLPRDQINFAGWGLLCKNKGTLHEIIDPYIKDQIDPNSLRKFSETIEKSLQEDGLDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 11110 - protein, 401 aa, Acinetobacter sp. EB104
MQTIVIIGASHAAALAASLRPDGWQGEIVVIGDEPYLPYHRPPLSKTFLCGAQLVDELLIRPAAFYQKNQIEFRHGRVVAIDRAARSTLQDGSTLAYDQLALCTGARVRTVSLAGSDLAGVHYLRNSDVQANQPFVQPNGKAVVIGGGYIGLETAAALTEQGMQVVVLEAAERILQRVTAPEVSDFYTRIHREQGVTIHTGVSVTAITGEGRAQAVLCADGSMFDADLVIIGVGVVPNIELALDAGLQVDNGIVIDEYCRTSAPEIVAIGDCANAFNPIYQRRMRLESVPNANEQAKIASATLCGLQRTSKSLPWFWSDQYDLKLQIAGLSQGYDQIVIRGDVQQRRSFAAFYLQAGRLIAADCVNRPQEFMLSKKLITAGTAVDPLRLADESIAVQALMG

SEQ ID NO: 11111 - protein, 170 aa, Triticum aestivum
MPRSRVNGNFIDKTSSIVANILLRIIPTTSGEKKAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 11112 - protein, 449 aa, Staphylococcus aureus
MMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 11113 - protein, 1142 aa, Bacillus sp. KSM-1876
MKGKLKKFLVLSMVFILTFSSFGMMGTTQLVEAETKSSIEESEIPENTLRIHYQNSSGDYSNLGVWTWDDVESPTDNWPSGGIPFTEEQVTDYGAYVDVPLESGARNVGFLILDIVTGGKDDAGHNGGDKRLELFSPNINEVWISEGSDEISFIEPVDLPEDTVRVHYKKADGNYENWSLWFWGDVQSPSETQGDFPSGATGFSEEQIGKYGAYIDIPLNEGAEEIGLVVVNKETNEQEADRSFTQLNQFNQIFIVEGDGAVYSNPYGAIATELLSAEQLSDEKIVLYFSRTDELTEEALLEQVGIRDIEEHTVDVNEVEIKTDNRTVEVKGDFNLDQSPYTVSLGEVSVPAKIGWRLIDEMYAYDGELGAQLHQDGTATIKLWSPKAEHVQVILYDKDNPDDIVTEVEMKLGDRGVWEVQLTKENTGLDSLRGYYYHYEIDHDGDKKIALDPYAKSLSAWNSDEQGPYAKAAIVDPSSIGPELEFAHIEGFEKKEDTIIYEVHVRDFTSDPHIADELTAQFGTFASFVDKLDYIEDLGVTHIQLLPVMSYFFANEFKNDERMLDFSSTNTNYNWGYDPQSYFALTGMYSEDPTDPELRIKEFKKLIDEIHSRGMGVVLDVVYNHTARVGIFEDLVPNYYHFMDADGTPRTSFGGGRLGTTHEMSRRILVDSITYWVEEFKIDGFRFDMMGDHDAESIQIAYDKAKEINPNIVMIGEGWITYAGDEDDPNVQAADQHWMQYTESVGVFSDEFRNELKSGFGHEGEPRFLTGGARNIDLIFDNIKAQPHNFIADDPGDVVPYIEAHDNLTLHDVIAMAIQKDPDDHQEEIHQRIRLGNLMTLTSQGIAFLHAGQEYGRTKQFRAETSEPPYKSTYMTDENGEPFRYPYFIHDSYDSTDIINRFDWERATNADAYPIQNLTREYTTGLIELRRSSDAFRLGTKDLVDEKVTQLNIPEIEETDLVVAYRIEATTGEAFYVFVNADDEERTLTLEEDLTVGEFVVDGKTAGVTAIAEPQGVELSAEQIKLDPLTAAIVQVGGIEAPEKPTPPKEEPKEPKEPKEPKEPKEPKDPKDPKDPKDPLDPPGTDDQNGETPKGNEEKKEEQKGDNLPNTATSNYQFIALGIALVLMATAIYWWKRKRQVA

SEQ ID NO: 11114 - protein, 281 aa, Beta vulgaris
MTKEVSEEAQVHQHGKDYVDPPPAPLFDMGELKLWSFWRAVIAEFIATLLFLYITVATVIGYKNETDPCATVGLLGIAWSFGGMIFILVYCTAGISGGHINPAVTFGLFLARKVSLLRAFFYMVGQCAGAICGVGLVKAFMSGAYVRLGGGANSVQPGYNKGTALGAEIIGTFVLVYTVFSATDPKRSARDSHVPILAPLPIGFAVFMVHLATIPITGTGINPARSFGAAVIFNDKKAWDDHWIFWVGPFVGALAAAAYHQYILRAAAIKALGSFRSNPTN

SEQ ID NO: 11115 - protein, 195 aa, Zea mays subsp. mexicana
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNHKPRTDLPNVVELYMKKELEVEKFITHSVPFAEINKA

SEQ ID NO: 11116 - protein, 472 aa, Anemia phyllitidis
GMLINDKQVVVTPFVRRQERELTNAATKFNNVFVKNLAEETTDEDLMEVFGGFGPISSAVVMRDANGNSKCFGFVNFKNADDAAKAVENINGKVFNDKEWYVGRAQKKSEREAELKVKFEQLRKERTEKFQGVNLYLKNVDDSIDDEKLKELFSGFGTVNSCKIMRSPQGQIVGSGFVALSSKDEAMRAVNEMNGKMVGSKPLYVAVAQRKDERRAKLQAQFAQLRNVVANVPQMNGSPGPLYPPRPPAMGQQVYYGQPPHGLLPPQPSGFGYQHPMVPGMRPGGPQMPNYFLPAVQRPGQQGQRMGNRRPGPPFLHQQQQPLMQQQMAPRGNSRPMRYSQSSRVAPDVSLQGYSSLDMGGALPNSSDTGLYMPALASALASASPEQQRVMLGEQLYPLVDRLEHDHAGKVTGMLLEMDQTEVLHLIESPEALKAKVAEAMDVLQMAQANAGASTNGIDHFASLSLNEPLAS

SEQ ID NO: 11117 - protein, 418 aa, Staphylococcus aureus
MHFTLVFILFLGGIYMTFEKETVLKTLFPEDVLSIAKGLTDGEVEFLQQVDSLLESKYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 11118 - protein, 110 aa, Arabidopsis thaliana
RASRTSLFDGLDGLEEGRLRASSSYAHDERDNDEALENLQDRVSFLKRVTGDIHEEVKNHNRLLDKVGNKMDSARGIMSGTINRFKLVFEKKSNRKSCKLIAYFVLLFLI

SEQ ID NO: 11119 - protein, 504 aa, Arabidopsis thaliana
MVVINSLRRLARTTQVHLHSRYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 11120 - protein, 169 aa, Gossypium hirsutum
FGSVSYSDLGAFRYLAHANGICAGYSLLSAIIAAVPSPSTMPRAWTFFLLDQILTYVILGAAAVSTEVLYLANKGDSAITWSAACGTFAGFCHKATIAVVITFVAVICYAVLSLVSSYRLFTKFDAPVNYPSKTIEATVFHGRFMLLLKLITLYFHVLLVIIIKKGCLQ

SEQ ID NO: 11121 - protein, 197 aa, Oryza sativa
MSTARFIKCVTVGDGAVGKTCMLISYTSNTFPTDYVPTVFDNFSANVVVDGNTVNLGLWDTAGQEDYNRLRPLSYRGADVFLLAFSLISKASYENIHKKWIPELRHYAPNVPIVLVGTKLDLREDKQFFLDHPGLAPISTAQGEELKRMIGAAAYIECSSKTQQNVKSVFDSAIKVVLCPPKPKKKNTRKQRSCWIL

SEQ ID NO: 11122 - protein, 358 aa, Saccharomyces cerevisiae
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSPPRGHIHDGTDKDDECNFEGHVHTTWGDCCGIKLPSAIAATEMNKKHHKPIPFD

SEQ ID NO: 11123 - protein, 423 aa, Streptomyces coelicolor A3(2)
MTITQPDLSVFETVESEVRSYCRGWPTVFDRAVGSRMYDEDGHEYLDFFAGAGSLNYGHNNAVLKRALIDYLERDGVTHGLDMSTTAKRRFLETFQNTILRPRDLPYKVMFPGPTGTNAVESALKLARKVKGRESIVSFTNAFHGMSLGSLAVTGNAFKRAGAGIPLVHGTPMPFDNYFDGTVEDFIWFERLLEDQGSGLNKPAAVIVETVQGEGGINVARAEWLRALADLCERQDMLLIVDDIQMGCGRTGAFFSFEEAGITPDIVTVSKSISGYGMPMALTLFKPELDVWEPGEHNGTFRGNNPAFVTATATLEAYWADGSAMEKQTRKRGEQVEQHMIAITEENLADVKEYRGRGLVWGLEFHDKDRAGRVAKRAFELGLLIETSGPESEVVKLLPALTITPDELDEGMKTLARAVRETA

SEQ ID NO: 11124 - protein, 444 aa, Streptomyces coelicolor A3(2)
MSTQRWHGHATKRAAALVGCTALVLSLTAATAEARPGHHHPRDTARQTLPAGDGWASQGPGTTGGSAADAEHVYTVSTWAEFRAALAADGTAPRIIKVKGTVDAVSEGCEAFAAPGYDFDAYLEKYSPENWGMDTDLSAEPDDSPEGLRRVSAARQDRTIKANVPSNTTIIGVGRGAALKGASLQIKGVDNVIVRNLTFESPVDCFPQWDPTDGDRGNWNSEYDSAVVYGSTHVWLDHNTFTDGEHPDSAAPTYFGMLYQQHDGQLDIVKGADYVTASWNVFTEHDKTILIGNSDSESTAAVDRGHLRATFHHNLFKNLVERAPRVRFGQVDVYNNHFVASDDYAYSFGVGKESALVAEHNAFTLPAGVSPAKVLKRWNDSPLSAAHNRVNGRTVDLIAAHNAENPDAVLRSGAGWTPSLRTKVLPARAVPFVVDHGAGAGRLR

SEQ ID NO: 11125 - protein, 171 aa, Rhizobium tropici
NSLVMSHSLHVAVQGLEDVAVIASEDAVYVGHLKDSQEVGKLVKLLASEKKTAKLTETHPTSYRPWGGYTSVLNGERFQVKRIFVLPGKKLSLQKHHHRSEHWIVVKGTAEVTVGENVQMLRENESIYIPLGEVHRLANPGKILLELIEVQTGSYLGEDDIIRLVDEFGRS

SEQ ID NO: 11126 - protein, 331 aa, Rhizobium tropici
SAFRKLAMQFHPDKNPDDSNAERKFKEINEAYETLKDPQKRAAYDRYGHAAFEHGGMGGGGGFGAGFGGGGFSDIFEDIFGEMMGGGRARGRSSGGRERGADLRYNMEISLEEAFSGKTAQIRVPTSITCDVCSGSGAKPGTQPKTCGTCQGSGRVRAAQGFFSVERTCPTCHGRGQIIPDPCTKCHGQGRVTEERSLSVNIPAGIEDGTRIRLQGEGEAGLRGGPSGDLYIFLSVKPHEFFQRDGADLYCAVPISMTTAALGGTFDVATLDGTKSRVSVPEGTQVGKQFRLKGKGMPVLRSSQVGDLYIQIQIETPQKLTKRQRELLQEF

SEQ ID NO: 11127 - protein, 399 aa, Hyphomicrobium sp. JC17
MAKIVCVLYDDPVNGYPKSYARDDIPKITKYPDGQTTPTPQAIDFVPGHLLGSVSGELGLRKYLESNGHTLVVTSDKDGANSRLDQELPDAEIVISQPFWPAYMTAERIAKAPKLKMIVTAGIGSDHTDLQAAMDRGITVAEVTYCNSNSVAEHVVMQMLSLVRNYIPSYNWVIKGGWNIADCVERSYDIEGMHVGTVAAGRIGLRVLRLLKPFDVHLHYMDRYKLPDAVEKELNLTHHTSLESLTKACDVVTLNCPLHPETEHMINDKTLKNFKRGAYLVNTARGKLCDRDAIVRALESGQLAGYAGDVWFPQPAPQDHPWRKMPHHGMTPHISGTSLSAQARYAAGTREILECYFDKKPIRNEYLIVQGGKLAGVGAHSYSAGNATSGSEEAAKFKR

SEQ ID NO: 11128 - protein, 200 aa, Staphylococcus aureus
MWQKSLVPMPKDQFVTALRDADACFITLSEQIDAEILAQSPNLKVIANMAVGYDNIDVESATANNVVVTNTPNVLTETTAELGFTLMLAIARRIVEAEKYVEADAWQSWGPYLLSGKDVFNSTIGIYGMGDIGKAFARRLQGFNTNILYHNRSRHKDAEADFNATYVSFETLLAESVLSSVQRHLQKKHIINLMLKHLNK

SEQ ID NO: 11129 - protein, 156 aa, Fagus sylvatica
MNSRAFIFLALLFASVLLISSAVATKTSKDEEKPEESNPVDDTKYGGYGGHYGGGHGGGYGGGHGGGYGGGHGGRGGGGGGRGGGGGYGGRREHVAEESIGRDTKYGGYGGGHGGHGGHGGGHGGGHGGGGGGPSRKLKAKLYNSLKSFASSYVPK

SEQ ID NO: 11130 - protein, 215 aa, Fagus sylvatica
MARRADEEYDYLFKVVLIGDSGVGKSNLLSRFTRNEFCLESKSTIGVEFATRTLQVEGRTVKAQIWDTAGQERYRAITSAYYRGAVGALLVYDVTKPTTFEQVWLKELRDHADSNIVIMLIGNKTDLKHSRAVRTEDAQGFMLRKKALSFIETSALKATNVEKAFQTILCLRFTGIISKKSLSSDEPAPSVIKEAVKHIVVGGSEANTKKPCCSN

SEQ ID NO: 11131 - protein, 285 aa, Methanothermus fervidus
MGLKFAYSKDPSSLKYLSNKKVFGLLGVPFDSTSTYKPGSRFGPLMIRQASYNFENYSLHYRKKLDVPIIDLGDIEVILGDFKNTCRNISEKVQEVLKKGMIPIVLGGEHSITYGVVKTFDLSDVTILHFDAHMDMANTYAGKKFSHATVMRRIYELHPKKIVQIGVRSCTKEEHEFVLNENIKYYTSRDIIEKFNMVLNEINKLDGPFYVTVDIDVLDPGYAPGVGNPTPVGITPYHMEKFIEKIARKKIIGIDIVEVATDRIGDPAAMNAAKILYDFLFAIKI

SEQ ID NO: 11132 - protein, 484 aa, Acinetobacter calcoaceticus
MSIFTKELWDKKLFNGSWQSAQDTYSVIEVATGQVLGEIGYATAADVVSAAQQAKAAQQQWWALNYQERQAVFERAAALLTENQAEVIEWLVKESGSLQLKAGFEVSIAIQVLKHCIASPTNEQGTLLPTQNGKLSIAKRLPLGVVGVISPFNFPLYLALRAVAPALAFGNAVVLKPDERTAVCSGYVIARIFELAGLPKGLLHVLPGGVEVGEALTLDQNIASIQFTGSTQVGRIVGANAAKTLKKVSLELGGKNSLIILDDADIELAAENIAWGAFLHSGQICMTSGKILIHQKIYQQVKQRVIEKVQNFVVGNPCDKNVTIGPLINAKQAQRVEQLVSAAVNEGATLEIGGHADGVFFQPTVLTDVTANNSIFSEEIFGPVAVLIPFSSDEQAIELANDGDYGLSAGIITSNVGRGMQLGAQLKVGLLHINDQTVNDETVNPFGGFGSSGNGTRIGGPANADEFTQWQWITVQAQAPHYPF

SEQ ID NO: 11133 - protein, 371 aa, Acinetobacter calcoaceticus
MSELKDIIAAVTPCKGADFELQALKIRQPQGDEVLVKVVATGMCHTDLIVRDQYYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSLVTWGAGAVGLSALLAAKVCGASIIIAVDIVESRLELAKQLGATHVINSKTQDPVAAIKEITDGGVNFALESTGRPEILKQGVDALGILGKIAVVGAPQLGTTAQFDVNDLLLGGKTILGVVEGSGSPKKFIPELVRLYQQGKFPFDQLVKFYAFDEINQAAIDSHKGITLKPIIKIA

SEQ ID NO: 11134 - protein, 242 aa, Xanthomonas campestris pv. campestris
MNQVARGAGAKRYADAKAALAGVVADGQTLAVGGFGLCGIPEALITALRDSAVSGLTVISNNAGVDGFGLGQLLATRQIRKMISSYVGENKEFERQYLAGRTRAGIQSAGTLAERLRAGGAGIPAFYTATGYGTIVADGKETREFDGKHYVLETALQADVALIKAWRADTAGNLVFRKTARNFNPACAMAGRICIAEVEEIVELGAIDPDQVHLPGIYVDRLVLNATPEKRIEQRTVRQGDK

SEQ ID NO: 11135 - protein, 467 aa, Xanthomonas campestris pv. campestris
MSDVLPIILSGGSGTRLWPLSRETYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGAGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGDEVLLLTENQSTYIPLGVTHRLKNPGKLPLELIEVQSGSYLGEDDIVRFEDTYGRT

SEQ ID NO: 11136 - protein, 456 aa, Xanthomonas campestris pv. campestris
MAIHSSVLELIGNTPIVKAQRLDTGVCELFLKLEASNPGGSIKDRIGLSMIEAAEQRGDLRPGATLVEGTAGNTGLGLALVAQQKGYRLILVVPDKMSREKIFNLKAMGADVVLTRSDVAKGHPEYYQDLAAKIASETPGAYFINQFGNPDNPAAHEFGTGPEILAQMDGQLDAIVFGCGSSGTMTGLSRAFATASPQTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLEREQHGDLRDLILRPYNKRDTVVVGPKDLLTTAYQRMKLYDVSQLPVIDDGELVGIVDESDVLLHVYGDEARFRDPISTAMVSKLDRLDVASPIEALLPVFDRGQVAIVMDGNQFLGLITRIDLLNYLRRRVQ

SEQ ID NO: 11137 - protein, 430 aa, Mesembryanthemum crystallinum
AILAAVVGSQAIITGTFSIINQCHALGCFPRVKIVHTSSKVHGQIYIPEINWLLMILCLAVTIGFRDTKRMGNASGLAVITVMLVTTCLMSLVIVLCWRKSVFLAVAFVVFFGTIEALYFSASLIKFLEGAWVPIALAFIFMLVMLAWQYGTLKKYEFDVQNKVSINWLLSLGPSLGIVRVRGIGLIHTELVSGIPAIFSHFVTNLPAFHQVLVFLCIKSVPVPHVRPEERFLVGHVGPKEYRLYRCIVRYGYRDFHKDDMEFEQDLVCSIAEFIRAENTKMNGLKEDLDKDANEKMTVVGSPSTHLDRIRICEDFGDEDEDMPGTSEMKEIQSPMITTRKRVRFVLPESSPKIEDGAREELKDLMEAREAGIAYIMGHAHVRAKHGSSWLKKLAINVGYDFLRRNSRTPTYPLSVPHASTLEVGMIYHV

SEQ ID NO: 11138 - protein, 469 aa, Oryza sativa
MSSSSSSGWSSKKVCVVGAGMAGLAAARELRREGLDVTVLEQSADVGGQWLYDAATDGRDPLGMAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGQYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAGKVTVDDNRVGPLYEHVFPPALAPSLSFVGIPVKVILPRFAEVQARWVAQVLSGRRTLPSPGEMLRAVEEYNRAKEAAGLPKRQTHDLFLDLEYCDEYGERHCGFPRTEQWKKELIWSSISDMCDDIENFRDDYHDSDIVRDGRRLHGWASSPPLAPRPQEKDDDHDKEEDKHLGFGPSKFSLR

SEQ ID NO: 11139 - protein, 212 aa, Oryza sativa
MERSGERRRERVVAAALAVLLLVFASAFVRCRGDADGEGDGAGAAEPGKTGPPLPPGWKGGSGSGQGSSPDGAWRYGWGWAASPGGKGSGFGFGYGGSRGEGGGGGGGGGGGSGRAYGFGGGYGGHPGGFGGGGGGGGGGRNYGGGSGGIGGYGNYGGGYNGEPGGGGGGAGEGGGYGGDYGGGDVGANWSKRGSFRGGGGKTQQKDGGGNN

SEQ ID NO: 11140 - protein, 227 aa, Oryza sativa
MGKRWIPLEANPDVMNQFMWGLGVAEGEAQFCDVYGLDDELLAMVPQPVLAVLFLYPLTSLDDDEEESGAAATSTAGDKDLSKRVYFTKQTVGNACGTVGVIHAIGNAASKLKLVEGSYFDRFYKQTVDMDPRAAFLEEDDEMEDAHSVAASAGDTDANVEVNEHFVCFSCVDGELYELDGRKSQPICHGPSSPDTLLQDAAKVIKARIASNPDSMNFNVMALSKVV

SEQ ID NO: 11141 - protein, 420 aa, Oryza sativa
MYGRMPKKSNNTKYYEVLGVSKTATQDELKKAYRKAAIKNHPDKGGDPEKFKELAQAYEVLNDPEKREIYDQYGEDALKEGMGGGSSSDFHSPFDLFEQIFQNRGGFGGRGHRQKRGEDVVHTMKVSLEDLYNGTTKKLSLSRNALCTKCKGKGSKSGAAATCHGCHGAGMRTITRQIGLGMIQQMNTVCPECRGSGEMISDKDKCPSCKGNKVVQQKKVLEVHVEKGMQHGQKIVFQGEADEAPDTVTGDIVFVLQLKDHPKFKRKFDDLFTEHTISLTEALCGFQFVLTHLDGRQLLIKSNPGEVIKPGQHKAINDEGMPQHGRPFMKGRLFVEFNVEFPEPGALTPGQCRSLEKILPPRPRNQLSDMELDQCEETTMHDVNIEEEMRRRQQHRRQEAYDEDDDEDAGAGPRVQCAQQ

SEQ ID NO: 11142 - protein, 320 aa, Brassica rapa subsp. rapa
MEENIKPPVIDLSKLNDEERDQTMALIDDACQNWGFFELLNHGIPYDLMDNIERMTKEHYKKFMEQKFKEMLRSKGLDTLETEVEDIDWESTFFLHHLPQTNLYDIPNMSDEYRTAMKDFGKRLENLTEELLDLLCENLRLEKGYLKKVFRGTKGPTFGTKVSNYPPCPNPEMIKGLRAHTDAGGLILLFQDDKVSGLQLLKDGDWVDVPPLKHSIVINLGDQLEVITNGKYKSVMHRVMTQKEGNRMSIASFYNPGSDAEISPAQSLVDKESEYPSFVFDDYMKLYSGVKFQPKEPRFEAMKNAAVTTDVNPVATEETF

SEQ ID NO: 11143 - protein, 333 aa, Nicotiana tabacum
MSKARVYTDVNVLRPREYWDYEALTVQWGDQDDYEVVRKVGRGKYSEVFEGINVNSHEKCIIKILKPVKKKKIKREIKILQNLCGGPTIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQDRLTAREAMAHPYFLQVRAAENSRMRTQ

SEQ ID NO: 11144 - protein, 475 aa, Pinus balfouriana
MSPKTETKASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 11145 - protein, 496 aa, Avicennia marina
MPTRQLFIDGEWREPVQRKRIPIINPANEQTIGDIPAATAEEMDIAVEAARKAFFRNSGKDWSSTTGAHRAKYLRAIAAKIKDRKVELVELEAIDSGKPLEEASLDMDNVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIATTFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAVELANDTHYGLAAAVISKDLDRCERMAKAFQVGAVWVNCSQPCFYQAPWGGKKRSGFGRELGERGLDIYLNVKQVTRYVSSEPWGWYKSP

SEQ ID NO: 11146 - protein, 230 aa, Emericella nidulans
MSSGRVSEATNITQPPAYSKKFVVVGDGGCGKTCLLISYSQGYFPEKYVPTVFENYITQTLHRRSGKTVELALWDTAGQEEYDRLRPLSYPETDLLFVCFAIDCPASLENVMDKWYPEVLHFCPTTPIILVGLKSDLRNKRTCIELLKTQGLTPVTPEQGQAVAGRMNASYVECSSKEMRGVDSVFQLAVDTVVSLEEQNWDTRLPSSSGKPGGKPIGGKKIKKRSCKIL

SEQ ID NO: 11147 - protein, 419 aa, Brassica oleracea
EIQNETAQTDQTQGSMFSFFDLFPFLLPMFEVIKMVVASVASVVYLGFAGVTLSGSAVALAVSTPLFIIFSPILLPAIAATTVLAAGLGSKKVAAAPAASPSLSLLGIPESIKPSNVIPESIKPSNIIPESIKPSNIIPESVKPSNIKDKIKDTIGKVKNKINAKKEEKSKGKSEDSSKGKGKSKGEDTTTDEDKPGSGGKHGKGESKHGKGESTHGKGGKHGSEGSSMDEGKHGGKHGSGGSPMGGGKHGSGGKHESGGSPMGGGKHGSGGKHESGGASMGGGKHESVGKHGSGGKHESGGSPMSGGKHGSGGKHESGGASMGGGKHGSGGRHEGGGSAMGGGKHGSGGKHGSEGKHGGEGSSMGKNSLSKNKKEFHYRDQAMDASSTSESSDGSSDGSSSDGSSSDGSSHGSGGKHI

SEQ ID NO: 11148 - protein, 1044 aa, Pichia angusta
MTCSVPPLPEDISPRAAKKKLVIVGLGMVGLSFLEKLLSNDSKLNEYSIMVYGEEPYLAYNRVGLTEYFQHREFKNLLLSPEEFYQLRGEKWNYAIDEKVVDIDRRARIITTDKGNRASYDVLVLCTGSAAILPTDLLPPLTRKSYREMGCFVYRTIDDLYSMIDYCQGAKKTRAIVVGGGLLGLEAAKALYDMESFEDITIVHRSHWLLSQQMDQKGGSLLTSKVKELGITCRTGTTVSELLFDEDQNLKGVKYDNGQIEECSLLCYTIGIKPRDELTSCGLNAGSRGGFKVNNMLQTSDENIYAIGECASWNNMTFGLIAPGYEMADILAFNLTQGKLHQPKEFSEPSMGTRLKLMGVDVASFGDFFADRNGPKWLLADTTKKFVDLVFEDPIDATYTKLLFTKDGKYMLGGILVGDTSNYTKFSAMIRKPLPKSPSELLIGKSGEDDMEMLSDETQICSCHNITKGKLVEAVKNGCSSLADVKKCTKAGTACGGCEPTVKIIFEKELKKLGGKVSNNLCVHFDYSRVDLFSLIMVKNFRSFRRVMEELGNDPSSSGCEICKPTIGSILSTLYNRHLLKKEVHGLQDTNDRYLGNIQRDGTFSVVPRMSAGEITPEKLVSIGKIAKKYGVYTKITGAQRLDLFGVKKSDLLKIWKDLNEAGFESGQAYGKSLRNVKSCVGSTWCRYGIGDSVGLAVRLEERYKGIRSPHKMKGGVSGCVRDCAEFHSKDFGLCAVSGGFNIYVGGNGGMKPRHAQLLATNVRPDEVIPILDRYLMFYITTADRLQRTARWLENLDGGIEYLKDVIIRDKLGICKDLEAQMRHVVAGYYDEWAKAVSEEKENPIFKQFVNTPENQDCVEIVNERGQPRPAMWPEKAANQKFNEIRWSSVSWQEVCECSDLPLAEAGSSATVLVGDTQIALFRTSKNELYCSQNMCGHKRAFVLNQGLLSEDSDKNCYISCPMHKRNFYLKSGACKNDEALSIATFEVKEENGKVYAKLPPLKELDEVLGTSKWKVTSQETEAKQVRKITTEKNLVDKAILLDW

SEQ ID NO: 11149 - protein, 148 aa, Mesembryanthemum crystallinum
GTAPFYLRHLPSSNIAEVPDLDDEYRSVMKEFALRLEKLAEEILDLFCENLGLEKGYLKKVFYGDKAPNFGTKVSNYPPCPKPDLIKGLRAHTDAGGVILLFQDDRVSGLQLLKDGEWIDVPPMRHSIVVNLGDQLEVITNGKYKSVM

SEQ ID NO: 11150 - protein, 478 aa, Candida albicans
MYQELPFDELKVDPRKRRVAYFYDQDVGNYFYGTGHCMKPHRIRMAHSLIMNYELYKKMEIYRAQPATNLELTQFHTDEYIDFIDRVTPDNLHIIEREQVIFNVGDDCPVFDGLGEFCKISCGGSMEGAARLNRGQADIAINYAGGLHHAKKSEASGFCYTNDIVLGIIELLRYHPRVLYIDTDVHHGDGVEEAFYTNDRVMTCSFHKFGEFFPGTGNLTDIGIGKGKYHAINIPLRDGIDDASYKSIFEPIITKIMEWYQPSAIVLQCGGDSLSGDRLGPFNLSMRGHANCVNFVRSLGVPMMVLGGGGYTIRNVARTWALETGVCNGEILPKELPYNGYYEYYAPTYELDVRSANMTNANSKEYLDKILTQVISNLDNTKHTPSVQMNEVPLDMEDLGDVDEDMPDAIDTKGGSQFAKDKLVQADGEFYDDDEKDKGEKNIQENGNVNTNANGNGNGNVIITEEEQAELDKLNNNV

SEQ ID NO: 11151 - protein, 473 aa, Salvia canariensis
MSPQTETKASVGFKAGVKEYKLTYYTPEYETKDTDILAAFRVTPQPGVPPEEAGAAVAAESSTGTWTTVWTDGLTSLDRYKGRCYHIEPVPGEKDQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFVEKDRSRGIYFTQDWVSLPGVIPVASGGIHVWHMPALTEIFGDDSVLQFGGGTLGHPWGNAPGAVANRVAVEACVKARNEGRDLAAEGNAIIREACKWSPELAAACEVWKEIKFEFPAMD

SEQ ID NO: 11152 - protein, 473 aa, Salvia glutinosa
MSPQTETKASVGFKAGVKEYKLTYYTPEYETKDTDILAAFRVTPQPGVPPEEAGAAVAAESSTGTWTTVWTDGLTSLDRYKGRCYHIEPVPGEKDQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVAVEACVQARNEGRDLAAEGNAIIREACKWSPELAAACEVWKEIKFEFPAMD

SEQ ID NO: 11153 - protein, 159 aa, Manihot esculenta
CTFDGSRGVSMTIESVVNENSQEVAGSLHDAMCSTCEMAVIWMQNQLKQNATLERILNYANELCERLPSPMGESAVDCGSLSTMPNVSFTIGGKVFDLSPEQYVLKVGEGEAAQCISGFTALDVPPPRGPLWILGDVFMGRFHTVFDYGNLRVGFAEAA

SEQ ID NO: 11154 - protein, 444 aa, Deinococcus radiodurans
MTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 11155 - protein, 498 aa, Rhizobium tropici
  misc_feature (188)..(188): Xaa can be any naturally occurring amino acid
  misc_feature (426)..(426): Xaa can be any naturally occurring amino acid
MARIIETSTGLDALTFDDVLLQPGHSEVMPGQTNIATRIAQDIELNVPILSAAMDTVTESRLAIAMAQAGGMGVIHRNLTPVQQAEEVRQVKKFESGMVVNPVTIGPDATLAEALSLDEGPRHFRASPVVEKSHRLVGILTNRDVRFASDPEQKIYELMTRENLVTVKDGVQQHEAKRLLHTHRIEKXLVVDADSRFVGLITVKDIEKSQLNPHASKDAQGRLRAAAAISVGDDGYERAERLIDAGVDLLVVDTAHGHSQRVLDAVTRVKKLSNSVRIMAGNVATYDGTRALIDAGADAVKVGIGPGSICTTRIVAGVGVPQLAAIMSAVQAAQDQNIPIIADGGIKFSGDLAKAIAAGASAAMIGSLLAGTDESPGEVYLYQGRSFKAYRGMGSVGAMARGSADRYFQAEVRDTLKLVPEGIEGXVPYKGPVSGVLHQLAGGLKAAMGYVGGADLKDFQERATFVRISGAGLRESHAHDVTITPRKARIIPAQAADR

SEQ ID NO: 11156 - protein, 455 aa, Chlamydia muridarum
MTTTKIKTQWACSECGSYSPKWLGQCPGCFQWNTLVEEIHSSKLKTSSYPLSSTTPVPLNTVKFQEEIRISTRSKGWNRLLGGGTVCGSLTLLGGEPGIGKSTLLLQISSQFAEQGYKVLYVCGEESVSQTSLRAQRLQISSSNIFLFPETNLEDIKQQISDLAPDILIIDSIQIIFSPSLSSAPGSVAQVRETTAELMHIAKQKQITTFIIGHVTKSGEIAGPRILEHLVDTVLYFEGNAHTNYRMIRSVKNRFGPTNELLILSMQTDGLHEVENPSGFFLQEKVVETTGSTIIPIVEGSETLLVEVQALVSSSPFSNPVRKTSGFDPNRFSLLLAVLEKRANVKLYTSDVFLSIAGGLKITQPSADLGAVLSVVSSLYNRYLPKNYTYTGEIGLGGEIRHVTHIEHRIKESIIMGFKGIVMPSGQIKGLPKEYLDQIDIIGVKTIKDAVRLLQ

SEQ ID NO: 11157 - protein, 433 aa, Synechocystis sp. PCC 6803
MVNATPFITTKSEEIFAAAQHLMPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 11158 - protein, 426 aa, Methanocaldococcus jannaschii
MALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 11159 - protein, 410 aa, Terrabacter sp. DBF63
DPRTVVVVGASVAGVRTAQSLRTEGFGGRIVLVGDEPDLPYDKPPLSKQFLAGCWSVERIALLTAEAAAAVGIELRLGVAAQRLDVAGRQVVLIDGSTIDYDAAVLATGAAARPAPWSATSGVHVLRSMADARALRDDLEVDRPVVIIGGGFIGAEVAATAHALGREVTVVDPLSAPIGRVVGREVGELFVDLHTRHGVTTKFGVGVESVEGEAGDLTVQLTDGSQLAAGTVVVGIGAVPNDGWLAGSGLLVDDGVVCDEHCRAVDAADVYAVGDVLRWFHPGHGEHVRVEHWTNAVESAAVVAHNIAHPEELRSHCPVEYVWSDQYDWKIQIVGRPVGATRHTLVGDLTSAHPRGAAVYTDDSGDLRGAVAVNWPKALLVCRRAVGAGASFDDVVAQLDRLSAAGAAPA

SEQ ID NO: 11160 - protein, 167 aa, Medicago sativa
MLVYQDLLTGDELLSDSYPYKEIENGMLWEVEGKWVTKGVVEVDIGANASAEGGEDEGVDDTAVKVVDIVDVFRLQEQPAFDKKQFLGFVKRYIKLLTPKLDAEKQELFKKHIEGATKYLLCKLKDLQFFVGESMHDDGSLVFAYYKDGAADPTFLYFAYALKEIKC

SEQ ID NO: 11161 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 11162 - protein, 339 aa, Saccharomyces cerevisiae
MPLPPSTLNQKSNRVYSVARVYKNACEERPQEYWDYEQGVTIDWGKISNYEIINKIGRGKYSEVFSGRCIVNNQKCVIKVLKPVKMKKIYRELKILTNLTGGPNVVGLYDIVQDADSKIPALIFEEIKNVDFRTLYPTFKLPDIQYYFTQLLIALDYCHSMGIMHRDVKPQNVMIDPTERKLRLIDWGLAEFYHPGVDYNVRVASRYHKGPELLVNLNQYDYSLDLWSVGCMLAAIVFKKEPFFKGSSNPDQLVKIATVLGTKELLGYLGKYGLHLPSEYDNIMRDFTKKSWTHFITSETKLAVPEVVDLIDNLLRYDHQERLTAKEAMDHKFFKTKFE

SEQ ID NO: 11163 - protein, 475 aa, Picea sitchensis
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEIWKEIKFEFEAMDTL

SEQ ID NO: 11164 - protein, 330 aa, Saccharomyces cerevisiae
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFIFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 11165 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 11166 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 11167 - protein, 476 aa, Anabaena sp.
MSYAQTKTQTKSGYKAGVQDYRLTYYTPDYTPKDTDILAAFRVTPQPGVPFEEAAAAVAAESSTGTWTTVWTDLLTDLDRYKGRCYDIEPGPGEDNQSIAYIAYPLDLFEEGSITNVLTYIVGNVFVFKALRALRLEDIRFPVAYIKTFQGPPHGIQVERDKLNKYGRPLLGCTIKPKLGLSAKNYGRAVYECLRGGLDFTKDDENINSAPFQRWRDRFLFVADAITKAQAETGEIKGHYLNVTAPTCEEMLKRAEYAKELKQPIIMHDYLTAGFTANNTLARWCRDNGLLLHIHRAMHAVIDRQKNHGIHFRVLAKALRLSGGDHIHTGTVVGKLEGERGITMGFVDLLRENYVEQDKSRGIYFTQDWASLPGVMAVASGGIHVWHMPALVEIFGDDFVLQFGGGTLGHPWGNARGATANRVALEACVQARNEGRNLAREGNDVIREAAKWSPELAVACELWKEIKFEFEAMDTV

SEQ ID NO: 11168 - protein, 444 aa, Bradyrhizobium elkanii
MTGICDSCTNSAAAAMIGVSDFDGILRGKHVLGEDLSVGNKVIKFSEAVLAWDCSDRVIPAGFTQEPQSVFGDADLRVLSGTGRSVSYAGDQYLYLAEFAGAHESVCPRGILRKVLQRVADRGYSCSAGFEFEFMLFKENADIIEDKPFGQWAPLTRGPFGYSIARSVAHRELFGEILALCEKSRIPLSGLHFETGPGVIEASLRHCDALEAADRAIIFKSMIKAWAQTRGMMATFMAKVSENWPGQSGHIHVSMSADGQNVFYDSEAFRNVSKLMRQFIGGQLKYMNDFCVLAVPNFNSYKRLVPGCWAPIYPSWGIDNRSCAVRVIPGDPSAHRLEYRLPGADLNPYLALACAIGSGILGIETNAALPASIVGDASAEACLPSGRLPQSLAEATYRFAQSPAANDVFGERFVEAFSCSRRWEWEAVQHRVTDFERRRYFEII

SEQ ID NO: 11169 - protein, 192 aa, Penicillium marneffei
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDPAVREKLAKQKMQPVRKEDGDRMAKELGAVKYVECSALTQYKLKDVFDEAIVAALEPAPKKRPKCVVL

SEQ ID NO: 11170 - protein, 505 aa, Citrus x paradisi
MDLLLLEKTLLALFAAVVVAITVSKLRGKRFKLPPGPLPVPVFGNWLQVGDDLNHRNLSDLAKKYGDVLLLRMGQRNLVVVSSPDHAKEVLHTQGVEFGSRTRNVVFDIFTGKGQDMVFTVYGEHWRKMRRIMTVPFFTNKVVQQQRFNWEDEAARVVEDVKKDPEAATNGIVLRRRLQLMMYNNMYRIMFDRRFESQDDPLFNRLKALNGERSRLAQSFEYNYGDFIPILRPFLRGYLKICKEVKERRLQLFKDYFVEERKKLASTKSMSNESLKCAIDHILDAQTKGEINEDNVLYIVENINVAAIETTLWSIEWGIAELVNHPEIQKKLRNELDTVLGPGHQITEPDTHKLPYLQAVIKETLRLRMAIPLLVPHMNLHDAKLGGYDVPAESKILVNAWWLANNPAQWKKPEEFRPERFLEEESKVEANGNDFRYLPFGVGRRSCPGIILALPILGITIGRLVQNFELLPPPGQSKIDTAEKGGQFSLHILKHSTIVAKPRSF

SEQ ID NO: 11171 - protein, 1233 aa, Stigmatella aurantiaca
MRAGAGGHPLLGVSFTTSVQKENRFWESALSAKEPSYLADHRVGGAVVVPGAAYLEMALSAARELSGEKAYELVDTSFKEGLLLPEGQERVVQMALSGEGGDALSFQLSSQKASTEPNAPAGWMAHVVGQIRPIEGGPSTQTPESFEAIRERCSEVIAQAAHYEELASRGVAYGPAFQGVQQIWRGRAEALGHVRLPEPLAARASAYRIHPALLDACFQLVAAAVPQEDLTPDAGPAVPVALAHLRLHEQPGTEVFCHVRLRPSEGARRGVYEFDLVLRDASGRILVEALGLRVQQLDAPAAEHAGKDLFFALEWRHASAVQQVPAEGPGASGRWLLIADGSELADTVESQLRERHGEVIRVDLAGAGQGRRVVDATSPQAFDGVLSEAFGAGSAPRGVIHLTGLEPREVDPIMGCGGVLHLVQALSRVSLASPPRLWLVTRGVHHGSGSRSASDVVQASLWGLGRTLAHEHSELKCTRVDVSAAMGTGDAGAALMRELLVADDEEEISLRADGRHVGRIVRGSPGRAPSEAVVPAGGRPFHLERDAQGRLEFRAGARRPPGPGELEIEVEVAALGGPGEGTGPERWEGAGEGIGCSGRVVAIGEGVKNVAVGEERIALVASGLGSHVSVPAGCTAIRPSSSSHGEAAALAATVLPAWYALFHLGRLEKRGRVWVLGATSGLGRAAIKLAKRAGAEVFAVATTDEQRASLRELGADQVMDPSDASFVSRVLDATGGRGVELAIVAPGAVELERSLPTLSEGARVLDLRASGASARTGDANVAWCVVDVQDFARRRPERFASLWQEVKAAFEAGGLPSAAADAKALALKDPKARVVVPAADARRLRADGTYLVTGGLGGLGLAVAKWMVEQGAGHLVLVGRDTVLSPEQQEVVTALEAAGARVRVARADVSDRAQIARILSEIAEGGAPLRGVIHAAGVLDDGVLLQQTVERFRRVMAPKVLGGWNLHVLTREAPLDFFVLYSSAASMFGAPGQGNYVAGNAFLDALAHHRRALGLPGLSINWGPFSEVGLAAAQANRGERLAQRGSDSLTPAEGNTILGRLLDGDVTQMAVMPLELRKWVEFYPRAKSSPWLSELVPADAGQEVGEARDVALLETLRTATPQEAKAALEQFVREQLARVLRLDSARIDPEAPLQSFGLDSLMGLELRNRLVSGLGVSLPASLIWKHPTLAALCAHLLGEVMDRTLAETLAQAAAGAGPAVDESAADDKEVFVL

SEQ ID NO: 11172 - protein, 297 aa, Schizosaccharomyces pombe
SGQNNVVGVHYKVGRRIGEGSFGVIFEGTNLLNNQQVAIKFEPRRSDAPQLRDEYRTYKLLAGCTGIPNVYYFGQEGLHNVLVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLL

SEQ ID NO: 11173 - protein, 220 aa, Saccharomyces cerevisiae
SSESIRMVLIGPPGAGKGTQAPNLQERFHAAHLATGDMLRSQIAKGTQLGLEAKKIMDQGGLVSDDIMVNMIKDELTNNPACKNGFILVGFPRTIPQAEKLDQMLKEQGTPLEKAIELKVDDELLVARITGRLIHPASGRSYHKIFNPPKEDMKDDVTGEALVQISDDNADALKKRLAAYHAQTEPIVDFYKKTGIWAGVDASQPPATVWADILNKLGKN

SEQ ID NO: 11174 - protein, 495 aa, Staphylococcus aureus subsp. aureus Mu50
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 11175 - protein, 394 aa, Staphylococcus aureus subsp. aureus Mu50
MNSIIELTDYYSSNNYAPLKLVISKGKGVKVWDTDGKQYIDCISGFSVANQGHCHPTIVKAMTEQASKLSIISRVLYSDNLGKWEEKICHLAKKDKVLSLNSGTEAVEAAIKIARKWGSEVKGITDGQVEIIAMNNNFHGRTLGSLSLSNHDAYKAGFHPLLQGTTTVDFGDIEQLTQAISPNTAAIILEPIQGEGGVNIPPKGYIQAVRQLCDKHQILMIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVDQLIQRGILCKDTHRTIIRLSPPLVIDKEEIHQIVAAFQDVFKN

SEQ ID NO: 11176 - protein, 403 aa, Staphylococcus aureus subsp. aureus Mu50
MTFEKETVLKTLFPEDVLSIAKGLTDGEVEFLQQVDSLLESNYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKKTGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 11177 - protein, 501 aa, Staphylococcus aureus subsp. aureus Mu50
MNFDWIKTRSDFDDDKPAVIDHAKQTSWTYQQLNARADNMAHYLTSQGVKKGDVIGIFAPNDIAILDLLFACFKTGAVFLPLNWRLNPKEIAAIVEDAQLKLLFYAEKHLSSLTDIDQNLLHMDIDVAQYDEIVNPDYHQPFQATPVEPQDLAALIYTSGTTGSPKGVMFSYESFVHNGANLELTYKFNSNYITIVSTPMFHVLGFNDTVLPVLMSGGTLILQRYFNGEELNDMIAQYHPTFIIMIPTMYYSTLRASNFNPENFRAMDYIIQGGSQPLPSIQAAFKQYGINIINGYGLTEAPLVLVNTPENSKRKPMSIGKAVMFVDARILDDNGEEVPTGEIGELAIKAKNVTPGYWNKPAETAKAFHGRYLLTGDLAKMDDDGDIFIIDRKKELIITGGENVLPSEVENALAEHPLVDRCVVVGYDHPKYGESIAAAIILREDEPHYAEILDQHMRSRLAGYKVPRMYVPVTHMPLNSTQKPDKLAIRQMMNDKVSQTL

SEQ ID NO: 11178 - protein, 478 aa, Staphylococcus aureus subsp. aureus Mu50
MTKLPQNFMWGGALAANQFEGGYEKGGKGLSVIDVMTSGAHGKARQITESIDLNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 11179 - protein, 399 aa, Staphylococcus aureus subsp. aureus Mu50
MYRYKPLLQSIHLPNGIKISNRFVLSPMTVNASTKEGYITKADLAYAARRSNSAGMQVTGAAYIEPYGKLFEYGFNIDHDACIPGLTNMASTMKQHGSLAIIQLAHAGRFSNQAILNFGKVYGPSPMTLHSPIEHVVIAMSHEKINSIIQQYRDATLRAIKAGFDGVEISIAQRLLIQTFFSTFSNRRTDHYGADSLKNRARLCLEVMRAVQEVIDKEAPDNFILGFRATPEETRGSDLGYTIDEFNQLIDWVMDVSNIQYLAIASWGRHIYQNTSRTPGDHFGRPVNQIVYEHLAGRIPLIASGGINSPESALDALQHADMVGMSSPFVTEPDFVHKLAEQRPHDINLEFSMADLEDLAIPHAAFKDIVKMMDYGEGLKKHTRDALRQLEQNYHDSSS

SEQ ID NO: 11180 - protein, 341 aa, Staphylococcus aureus subsp. aureus Mu50
MNNKVLVTGGTGFVGMRIISRLLEQGYEVQTTIRDLSKADKVIKTMQDNGISTERLMFVEADLSQDEHWDEAMKDCKYVLSVASPVFFGKTDDAEVMAKPAIEGIQRILRAAEHAGVKRVVMTANFGAVGFSNKDKNSITNESHWTNEDEPGLSVYEKSKLLAEKAAWDFVENENTIVEFATINPVAIFGPSLDAHVSGSFHLLENLLNGSMKRVPQIPLNVVDVRDVAELHILAMTNEQANGKRFIATADGQINLLEIAKLIKEKRPEIAQKVSTKKLPDFILSLGAKFNHQAKEGKLLLDMNRNVSNERAKTLLGWEPIATQEEAILAAIDSMAKFHLI

SEQ ID NO: 11181 - protein, 354 aa, Staphylococcus aureus subsp. aureus Mu50
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNA

SEQ ID NO: 11182 - protein, 201 aa, Staphylococcus aureus subsp. aureus Mu50
MHKVRSNIMTIYLVRHGESKSNYDNKHFRSYFCGQLDVPLTDTGTKSADDLCDYFKEKQIKHVYVSDLLRTQQTFEHIFPYDIASTTTPLLRERSLGVFEGEYKDEISANPKYEKYFNDPNFKDFRHSFSQKAPEGESYEDVYQRVEHFMNHVVNEDTQKDDIVIVAHQVVIRCLMVYFNKVSREEAVDLKVENCKPYIIE

SEQ ID NO: 11183 - protein, 341 aa, Staphylococcus aureus subsp. aureus Mu50
MIEFRQVSKSFHKKKQTIDALKDVSFTVNRNDIFGVIGYSGAGKSTLVRLVNHLEAASNGQVIVDGHDITNYSEKGMREIKKDIGMIFQHFNLLNSATVFKNVAMPLILSKKSKTEIKQRVTEMLEFVGLSDKKDQFPDELSGGQKQRVAIARALVTNPKILLCDEATSALDPATTASILTLLKNVNQTFGITIMMITHEMRVIKDICNRVAVMEKGQVVETGTVKEVFSHPKTTIAQNFVSTVIQTEPSTSLIRRLNDEQVGGFKDYKIFVEETQVTQPIINDLIQICGREVKILFSSMSEIQGNTVCYMWLRFNIDQQFDDTAINQYFKEKNIQFEEVH

SEQ ID NO: 11184 - protein, 487 aa, Staphylococcus aureus subsp. aureus Mu50
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLTAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 11185 - protein, 494 aa, Staphylococcus aureus subsp. aureus Mu50
MEKKNKQIDRGDLKQNLSEKFVWAIAYGSCIGWGAFILPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 11186 - protein, 482 aa, Staphylococcus aureus subsp. aureus Mu50
MLVILQLPCHIISKTNRISLLIFIMKKQSKMSLKTFKRRIYVMKTYDLIVIGFGKAGKTLAKYAASTGQHVAVIEQSSKMYGGTCINIGCIPSKTLVHDGLEGKSFEASYNRKNDVVNALNNKNYHLLADDNNIDVLDFKAQFKSNTEVNLLDQHGDIVDSITAPHIIINTGATSIIPNIKGLDQAKHVFDSTGLLNISYQPKHLVIVGGGYIALEFASMFANLGSKVTVLERGESFMPREDQDVVAHAITDLENKGIALHTNVETTELSSDDHHTTVRTNVGNFEADAVLLAIGRKPNTALALENTDIELGDRGEIKVNAQLQTSVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 11187 - protein, 312 aa, Staphylococcus aureus subsp. aureus Mu50
MKQFVNLGKSDVEVFPIALGTNAVGGHNLYPNLDEEQGKDVVRQAINHGINLLDTAYIYGPERSEELVGEVVKEYPREQIKIATKGSHEFDENQEVHQNNQPEYLKQQVENSLKRLQTDYIDLYYIHFPDDNTPKDQAVAALQELKEQGKIKAIGVSNFTLDQLKEANKDGYVDVVQLEYNLLHRENEAVLQYCVDHLITFIPYFPLASGILAGKYDENTKFSDHRTTRRDFIPGVFEENVRRVKALESLAAAHQTSIANIVLAFYLTRPAIDVIIPGAKRAEQVIENIKAADIVLSDDEIQYIDELFPIED

SEQ ID NO: 11188 - protein, 336 aa, Staphylococcus aureus subsp. aureus Mu50
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMEKGTITGRMVIKF

SEQ ID NO: 11189 - protein, 302 aa, Staphylococcus aureus subsp. aureus Mu50
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVDYLDSLLIHRPSPLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVVQSIADKYGVSDTAVMIAWLVKIPHSIMPILGTSQLKRIDQAIEGLQLNLDDQSWFDIYTAIIGQDIP

SEQ ID NO: 11190 - protein, 505 aa, Staphylococcus aureus subsp. aureus Mu50
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDTVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 11191 - protein, 375 aa, Staphylococcus aureus subsp. aureus Mu50
MKSKYEPLFDKVELPNGVELRNRFVLAPLTHISSNDDGTISDVELPYIEKRSQDVGITINAASNVSDVGKAFPGQPSIAHDSDIEGLKRLATAMKKNGAKALVQIHHGGAQALPELIPDGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 11192 - protein, 443 aa, Staphylococcus aureus subsp. aureus Mu50
MTHIQLDFSKTLEFFGEHELKQQQEIVKSIHKTIHEGTGAGSDFLGWVDLPVDYDKEEFSRIVEASKRIKENSDVLVVIGIGGSYLGARAAIEMLTSSFRNSNEYPEIVFVGNHLSSTYTKELVDYLADKDFSVNVISKSGTTTEPAVAFRLFKQLVEERYGKEEAQKRIFATTDKEKGALKQLATNEGYETFIVPDDVGGRYSVLTAVGLLPIATAGINIEAMMIGAAKAREELSSDKLEDNIAYQYATIRNILYAKGYTTEMLINYEPSMQYFNEWWKQLFGESEGKDFKGIYPSSANYTTDLHSLGQYVQEGRRFLFETVVKVNHPKYDITIEKDSDDLDGLNYLAGKTIDEVNTKAFEGTLLAHTDGGVPNMVVNIPQLDEETFGYVVYFFELACAMSGYQLGVNPFNQPGVEAYKQNMFALLGKPGFEDLKKELEERL

SEQ ID NO: 11193 - protein, 493 aa, Staphylococcus aureus subsp. aureus Mu50
MMKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYHEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPAAVAVKHMNPCGVGIGDTIEQAFQHAYEADSQSIFGGIVALNRAVTPELAEQLHSIFLEVIIAPKFTDEALDILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 11194 - protein, 446 aa, Staphylococcus aureus subsp. aureus Mu50
MPKRTFTKEDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 11195 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 11196 - protein, 242 aa, Staphylococcus aureus subsp. aureus Mu50
MTKLFIPYIMGNKDLIENATLLSENGADIIEIGVPFSDPVADGPVIMEAGQQAIKQGITIDYIFNQLEKHGDQIKCNYVLMTYYNIICHYGEQAFFEKCRDTGVYGLIIPDLPYELSQRLKQQFSHYGVKIISLVAMTTDDKRIKDIVSHAEGFIYTVTMNATTGQNGAFHPELKRKIESIKAIANVPVVAGFGIRTPQHVADIKEVADGIVIGSEIVKRFKSNTREEIIRYLQSIQQTLNN

SEQ ID NO: 11197 - protein, 302 aa, Staphylococcus aureus subsp. aureus Mu50
MQKNILKSGIALSELGLGCMSLGTDLKKAEQIIDCAVENGITYFDTADMYDKGINESVVGKALLKYQQRDDIFIGTKVGNRLTKDGSTTWDPSKSYIKEAVKGSLKRLGIDHIDLYQLHGGTIDDPLDETISAFDELKQEGIIRAYGISSIRPNVIDYYLKHSQIETIMSQFNLIDNRPESLLDAIHNNDVKVLARGPVSKGLLTSNSVNVLDNKFKDGIFDYSHDELGETIASIKEIESNLSALTFSYLTSHDVLGSIIVGASSVDQLKENIENYHTKVGLDQIKTARARVKDLEYTNHLV

SEQ ID NO: 11198 - protein, 468 aa, Staphylococcus aureus subsp. aureus Mu50
MTQQIGVIGLAVMGKNLAWNIESHGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 11199 - protein, 473 aa, Staphylococcus aureus subsp. aureus Mu50
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 11200 - protein, 428 aa, Staphylococcus aureus subsp. aureus Mu50
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 11201 - protein, 492 aa, Staphylococcus aureus subsp. aureus Mu50
MDFWLYKQAQQNGHHIAITDGQESYTYQNLYCEASLLAKRLKAYQQSRVGLYIDNSIQSIILIHACWLANIEIAMINTRLTPNEMTNQMRSIDVQLIFCTLPLELRGFQIVSLDDIEFAGRDITTNGLLDNTMGIQYDTSNETVVPKESPSNILNTSFNLDDIASIMFTSGTTGPQKAVPQTFRNHYASAIGCKESLGFDRDTNWLSVLPIYHISGLSVLLRAVIEGFTVRIVDKFNAEQILTMIKNERITHISLVPQTLNWLMQQGLHEPYNLQKILLGGAKLSATMIETALQYNLPIYNSFGMTETCSQFLTATPEMLHARPDTVGMPSANVDVKIKNPNKEGHGELMIKGANVMNGYLYPTDLTGTFENGYFNTGDIAEIDHEGYVMIYDRRKDLIISGGENIYPYQIETVAKQFPGISDAVCVGHPDDTWGQVPKLYFVSESDISKAQLIAYLSKHLAKYKVPKHFEKVDTLPYTSTGKLQRNKLYRG

SEQ ID NO: 11202 - protein, 429 aa, Staphylococcus aureus subsp. aureus Mu50
MNFSESERLQQLSNEYILGGVNSPSRSYKAVGGGAPVVMKEGHGAYLYDVDGNKFIDYLQAYGPIIAGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 11203 - protein, 489 aa, Staphylococcus aureus subsp. aureus Mu50
MYQLEDDSLMLHNDLYQINMAESYWNDNIHEKMAVFDLYFRKMPFNSGYAVFNGLKRVIDFIEHFGFSESDLEYLKSIGYKDDFLSYLKDLKFTGSIRSMQEGELCFGNEPLLRVEAPLIQAQLIETILLNIVNFHTLITTKASRIRQIASNDKLMEFGTRRAQEIDAALWGARAAYIGGFDSTSNVRAGKLFGIPVSGTHAHAFVQTYGDEYVAFKKYAERHKNCVFLVDTFHTLKSGVPNAIKVAKELGDKINFVGIRLDSGDIAYLSKEARRMLDEAGFTETKIIASNDLDEETITSLKAQGAKVDSWGVGTKLITGYDQPALGAVYKLVAIENEEGSYSDRIKLSNNAEKVTTPGKKNVYRIINKKTGKAEGDYITLENENPYDEQPLKLFHPVHTYKMKFIKSFEAIDLHHNIYENGKLVYQMPTEDESREYLAQGLQSIWDENKRFLNPQEYPVDLSKACWDNKHKRIFEVAEHVKEMEEDNE

SEQ ID NO: 11204 - protein, 264 aa, Staphylococcus aureus subsp. aureus Mu50
MQLYYLGPKGTFSYLACRQYFSENEATFQPKSNLFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 11205 - protein, 459 aa, Staphylococcus aureus subsp. aureus Mu50
MNIIEQKFYDSKAFFNTQQTKDISFRKDQLKKLSKAIKSYESDILEALYTDLGKNKVEAYATEIGITLKSIKNARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 11206 - protein, 319 aa, Staphylococcus aureus subsp. aureus Mu50
MRRLFSIGEALIDFIPNVTNANLKDVQTFTKQIGGAPCNVSCTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 11207 - protein, 335 aa, Staphylococcus aureus subsp. aureus Mu50
MKMIGFEKPFKLEEGNLFKVYEQRKPTPENDDILVKVNSISVNPVDTKQRQMKVTQAPRVLGFDAIGTVEAIGPDVTLFSPGDVVFYAGSPNRQGSNATYQLVSEAIVAKAPHNISANEAVSLPLTGITAYETFFDTFKISHNPSENVGKSVLIINGAGGVGSIATQIAKRYGLTVITTASRQETTEWCEKMGADIVLNHKEDLVRQFKEKEIPLVDYIFCTYNTDLYYNTMIELIKPLGHITTIVAFNEDQDLNALKLKSITFTHEFMFARPIHRTPDMIKQHEYLEDITKNIELGHYQPTTTQVFEGLSPENLYQAHQLLEKQSMIGKLVINI

SEQ ID NO: 11208 - protein, 317 aa, Staphylococcus aureus subsp. aureus Mu50
MEKVYVAGAIPEVGLKLLQEHFEVEMYEGKGLVDKDTLIKGVKNATALISLLSTNVDKDVIDAGKDLKIIANYGAGFNNIDIEYAREKSIDVTNTPKASTNATADLTIGLVLAVARRIVEGDQLSRTTGFDGWAPLFFRGREVSGKTIGIIGLGEIGSAVARRARAFDMDVLYTGPNRKEEKEREIGAKYVDLDTLLKNADFITINAAYNPKMHHLIDTEQFKMMKSTVYLINASRGPIVHEQALVQALKDNEIEGAALDVYEFEPDITDDLKSLNNVVLTPHIGNATFEARDMMSKIVANAAISAVQGEKPQFVVN

SEQ ID NO: 11209 - protein, 305 aa, Staphylococcus aureus subsp. aureus Mu50
MFQKLSIFATKSFLVWMLVAAVIGFIFPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFLSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 11210 - protein, 389 aa, Staphylococcus aureus subsp. aureus Mu50
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVIMIIGAVILGISDHIALFTVGCLTISICAGIGNGLIFKLVPSYFSNEAGSANGIVSMMGGLGGFFPPLVITYVANLTGSSHLAFIFLAVFGCIALFTMRHLYQKEYGSLKHS

SEQ ID NO: 11211 - protein, 243 aa, Staphylococcus aureus subsp. aureus Mu50
MIQLNNIHKSFNDVEVIKGIDLSVEQGEVVTLIGRSGSGKTTLLRMINALEIPTEGTVYVNGKTYTSKDKKSQIEVRKQSGMVFQSYNLFPHKTALENVMEGLITVKKLKKDEARGKSLELLEKVGLTHVKDQRPHALSGGQQQRVAIARALAMNPKVMLFDEPTSALDPELVNDVLKVIKDLANEGMTMVIVTHEMRFAKEVSNNIVFIHEGMIGEQGAPEEMFNRPKTEELRRFLNVINEE

SEQ ID NO: 11212 - protein, 452 aa, Staphylococcus aureus subsp. aureus Mu50
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEIMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNTFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 11213 - protein, 384 aa, Staphylococcus aureus subsp. aureus Mu50
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 11214 - protein, 457 aa, Staphylococcus aureus subsp. aureus Mu50
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCELAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 11215 - protein, 496 aa, Staphylococcus aureus subsp. aureus Mu50
MELLKHLSQRQYIDGEWVESTNKNTRDIINPYNQEVIFTVSEGTKEDAERAILAARRAFESGEWSQETAEKRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 11216 - protein, 210 aa, Staphylococcus aureus subsp. aureus Mu50
MTKYKIDFSKGLVPAILQDNQTKQVLMLGYMNQEAFDKTIEDGVVCFYSRSKQRLWTKGETSGHTQLVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 11217 - protein, 450 aa, Saprolegnia ferax
MVRLLPSLVAATLALVAAEVPVNVMLPLDTVVLDSKACSSTRLKNATALSLQFEKLKASGATGVMADCWWGLVEGAGPRQYDFAAYADLARLAKASNLTIQMVMSFHQCGGNVGDECDIPIPRHWFTKDDVWYTTQAGLITKEYISLWADATPLDKFGRTPLQMYSEFLAAFKTHVVDAYPGVVSEVQIGGGPAGELRYPSYQLQENRWSYCGVGEFTSYDTYANASIVAHAASTGHALWATRPGPNNAGTFNCLPSENGQCPFFANGADNFASPYGQFYLDWYSGSLLQHGRDLTKLGRDVFPAPFELSVKVSGIHWWYDSPHHGAELTAGYQNTNNKNAYYDIASMLKEHDVRFCFTCMEMNDNYDDNDKCRSRPGKLVGQARDAVTALGLSLKHSFAGENALPIGGNDQITSIAGHIAGAASFTFLRLTDTFDFDYLTRLVQRLKTV

SEQ ID NO: 11218 - protein, 126 aa, Ophiostoma novo-ulmi
TRSSTKSCLKSYKMAAPTSSGAVDQLAADLGNTSINGEKAAPVSTATEPTDTDAAGQAAPVHPQASASLYVGELDESVTEAMLFELFSQIGPVASIRVCRDAVTRRSLGYAYVNYNSTSDGEKARG

SEQ ID NO: 11219 - protein, 475 aa, Tsuga heterophylla
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQRNHGMHFRVLAKALRMSGGDHIHAGTVVGKLEGEREVTLGFVDLLRDNYIEKDRSRGIYFTQDWVSMPGVLPVASGGIHVWHMPALTEIFGDDSVLQFGGGTLGHPWGNAPGAVANRVALEACVQARNEGRDLAREGNEVVREACKWSPELAAACEVWKEIKFEFDTIDYL

SEQ ID NO: 11220 - protein, 1491 aa, Gibberella pulicaris
MATPDANMSSTRSEQSSHDTIVNNELSTNEKPLQSAPAPGDQTSSTDDEDDGPQTEEMVRRHSIVRDLARNYTNTSHHFNGSNADLFNAADPASPLNPSSENFNARAWAKAMSKSMNENGAGFRQSGLCFQDMNVFGYGAETDYQKDVGNVWLGLPSMAQQLFKPNAGKRRIDILRGFDGVVNAGEMLVVLGPPGSGCSTFLKSISGETNGIYVDDSTYFNYNGIAADEMHKHHKGETIYTAEVDVHFPMLSVGDTLTFAARARCPQNLPSGINHNQYSEHMRDVVMAMYGISHTVNTQVGDNYIRGVSGGERKRVTIAEATLSNAPFQCWDNSTRGLDSANAIEFCKTLRLQSELFGQTCAVSIYQAPQTAYDLFDKALVIYEGRQIFFGPADEAKAYFIGLGFECPDRQTTPDFLTSMTAPSERVVRPGFENKVPRTPDEFATCWKQSQQYQIVRAEVESYKSLYPINGSSADAFRENKQSAQAKGQRLKSPFTLSYMQQVQLCLWRGFKRLVGSPGVTIFQLIANTVVALIASSLFYNMEPTTGDFFKRGAVLFLAVLSNAFASALEILTQYAQRPIVEKHARYAFHHASAESFASILVDMPYKITNSILFNLTLYFMTNLNRDAGAFFFYLLVSFIMVLAMSGIFRSIASISRTLSQAMVPASLLILALVIFAGFVVPVDYMLGWCRWINYLDPVAYAFESLMVNEFSGRNFTCTGFVPNPLIPGYADVDDMNRACSTVGAVPGQSWVNGDDYLNLEYKYFHSNKWRNVGILIAMTIFNHIVYIVATEYISAKKSKGEVLVFRRSNMPANVKSDPEAASSGPIPVTEKNNNEVANIQGSTSVFHWNDVCYDIKIKGEPRRILDHVDGWVKPGTLTALMGVSGAGKTTLLDCLADRISMGVITGEMLVDGKLRDDSFQRKTGYVQQQDLHLETSTVREALTFSALLRQPASTPREEKIAYVDEVIKLLDMQEYADAVVGVLGEGLNVEQRKRLTIGVELAAKPPLLLFVDEPTSGLDSQTSWAILDLLEKLSKAGQSILCTIHQPSAMLFQRFDRLLFLAKGGRTIYFGDIGKNSETLTNYFVKNGSDPCPKGENPAEWMLEVIGAAPGSHTEIDWHQTWRESSEYQEVQGELQRLKAEGNANGGAEIHDAESYREFAAPFGEQLRIATTRVFQQYWRTPSYIYSKAALCIQVGLFIGLVFLNAPLSLRGLQNQMFAIFQVLTVFGQLVQMQMPHFVTQRSLYEVRERPSKTYSWKVFMLSQIMAEIPWNTLMSVFLFVCIYYPVGFQKNAEFAGQTAERGGLMWLLFWQFLIFTCTFAHAAIAITDTAEAGGNLANVVFMLSLFFCGVFGSPDNMPGFWIWMYRVSPFTYLVSAILSTGIGNAEVTCTAQELTTFNPPNGTTCGEYLESYIAQAGGYLTNNDATSDCKFCTIKDTNVYLEALSSSYDNRWRDFGIGMVYIVVNIVGALFLYWAFRMPKNKNKKQKKA

SEQ ID NO: 11221 - protein, 376 aa, Lycopersicon esculentum
MENKVVEEKQVDKIPLMSPCKMGKFELCHRVVLAPLTRQRSYGYIPQPHAILHYSQRSTNGGLLIGEATVISETGIGYKDVPGIWTKEQVEAWKPIVDAVHAKGGIFFCQIWHVGRVSNKDFQPNGEDPISCTDRGLTPQIMSNGIDIAHFTRPRRLTTDEIPQIVNEFRVAARNAIEAGFDGVEIHGAHGYLIDQFMKDQVNDRSDKYGGSLENRCRFALEIVEAVANEIGSDRVGIRISPFAHYNEAGDTNPTALGLYMVESLNKYDLAYCHVVEPRMKTAWEKIECTESLVPMRKAYKGTFIVAGGYDREDGNRALIEDRADLVAYGRLFISNPDLPKRFELNAPLNKYNRDTFYTSDPIVGYTDYPFLETMT

SEQ ID NO: 11222 - protein, 329 aa, Saccharomyces cerevisiae
GGHDVPLTNYLNAQYYTDITLGTPPQNFKVILDTGSSNLWVPSNECGSLACFLHSKYDHEASSSYKANGTEFAIQYGTGSLEGYISQDTLSIGDLTIPKQDFAEATSEPGLTFAFGKFDGILGLGYDTISVDKVVPPFYNAIQQDLLDEKRFAFYLGDTSKDTENGGEATFGGIDESKFKGDITWLPVRRKAYWEVKFEGIGLGDEYAELESHGAAIDTGTSLITLPSGLAEMINAEIGAKKGSTGQYTLDCNTRDNLPDLIFNFNGYNFTIGPYDYTLEVSGSCISAITPMDFPEPVGPLAIVGDAFLRKYYSIYDLGNNAVGLAKAI

SEQ ID NO: 11223 - protein, 506 aa, Perilla frutescens
MALYAALFLLSAAVVRSVLDRKRGRPPYPPGPFPLPIIGHLHLLGPRLHQTFHDLSQRYGPLMQLRLGSIRCVIAASPELAKECLKTHELVFSSRKHSTAIDIVTYDSSFAFSPYGPYWKFIKKLCTYELLGARNLAHFQPIRTLEVKSFLQILMRKGESGESFNVTEELVKLTSNVISHMMLSIRCSETESEAEAARTVIREVTQIFGEFDVSDIIWLCKNFDFQGIRKRSEDIQRRYDALLEKIITDREKQRRTHGGGGGGGEAKDFLDMFLDIMESGKAEVKFTREHLKALILDFFTAGTDTTAIVCEWAIAEVINNPNVLKKAQEEIANIVGFDRILQESDAPNLPYLQALIKETFRLHPPIPMLARKSISDCVIDGYMIPANTLLFVNLWSMGRNPKIWDYPTAFQPERFLEKEKAAIDVKGQHFELLPFGTGRRGCPGMLLAIQEVVIIIGTMIQCFDWKLPDGSGHVDMAERPGLTAPRETDLFCRVVPRVDPLVVSTQ

SEQ ID NO: 11224 - protein, 427 aa, Vibrio parahaemolyticus
MFSSRSLVDVLMLGQLGEAEIAAVGVAARATFVTTIMLVGVTTGGALLTAQYWGAGDKIGVRQSTSLTWMIAMVFAALAVCLFVFFPQPIMGLTTDSQEVIELGSSYLVISSASMFAVACVASMAVGLRAMHQPGLSTFFSGIGILSNVFLNWVLIFGHLGFPALGITGAAIATVISGAIEVGCLFGYLWLKKHIIAFGWGDIRASLVLDKITRFLSLSLPTTFNFLAWAGGLFAYHAIMGQAGVQGLAALSVMTPVESIALAMMIGLSNAAAVLVGNQLGAKNFEPVYYQAWATVILNVLIAFGVAVLLFFTNQLILDAFSALSAETRHLAEQFMVILALGVILRSVPMMVIVGVLRAGGDVKFCLYQDVFAQWIIGIPLAAFAAIYLGWEPQWVYLLFLTEEVVKWCICLPRMKSKKWMKNLIEK

SEQ ID NO: 11225 - protein, 1414 aa, Penicillium digitatum
MDGSEKGPGASSDDIQFDTESAMTITGEETPDKESSNLKGNDWRMMTKLQDDNDRNLAAGFKKQELGITWRDLSVQVTSSEAAVNETVLSQFNFPTIIKESRRKLPLRTILNKSHGCVKPGEMLLVLGRPGSGCTTLLKILANRRGGFKSVEGDVRFGSMQPKEAENFRGQIVMNTEEEIFFPSLTVGQTMDFATRLKVPFHLPDGMTALEYQEASKKFLLESVGISHTEDTKVGNEYVRGVSGGERKRVSIIECMATRGSVFCWDQSTRGLDASTALEWTKAIRAMTDTLNLSTVVTLYQAGNGIYDLFDKVLVLDEGEQIFYGTREQARPFMEDAGFICREGSNIADYLTGVTVPTERRIRDGFESRFPRNAEAVRAEYEKSPIYTQMIAEYSYPESDLARERTEEFKQGVAFETSKNLPKNSPFTVGFVDQVKICVQRQYQILWGDKGTFIIKQVATLCQALIAGSLFYNAPDNSGGLFVKSGALFFSLLYNSLLAMSEVNESFSGRPVLIKHKGFAYFHPAAFCLAQIAADIPVLLFQISMFGLVIYFMVGLSMSAGAFFSYWIIVFTTTMAMTALFRAVGALFSTFDGASKVSGSLIMFTVLYTGYMIPKPTMHPWLGWIFWIDPLAYGFEALLSIEFHDKTFIPCVGKNLIPTGPGYENAQAHQACAGVAGAISGQNFVVGDNYLASLSYSHSHVWRNFGINWAWWVLFVAVTMVATSNWQTPSESGSTLVIPREYLHKHVQNQQKDEEGQSLGKHVSQTKDEAPKSDNKLVRNTSVFTWKNLSYTVQTPSGDRLLLDNVHGWVKPGMLGALMGSSGAGKTTLLDVLAQRKTEGTIKGSIMVDGRPLPVSFQRSAGYVEQLDIHERMATVRESLEFSALLRQPATIPREEKLAYVDVIIDLLELHDLADSMIGSVGAGLSVEQRKRVTIGVELVSKPSILIFLDEPTSGLDGQSAYNTVRFLRRLADAGQAVLVTVHQPSAQLFAEFDQLLLLAKGGKTVYFGPIGENSQDIKSYFSRYGAPCPSETNPAEHMIDVVSGQLSQGRDWNKVWMESPEHSAMLKELDEIIETAASKPQATTDDGREFACTLWEQTSLVLKRTSTALYRNSDYINNKFALHISSGLVVGFSFWKIGDSVADLQSVLFFVFNAIFVAPGVINQLQPTFLERRDLFEAREKKAKMYSWKAFTIALIVSEFPYLVVCAALFFNCWYWTAGMTVDSSKSGSMFFVFFLYEFLYTGIGQFIAAYAPNAQMAAMTNPLILGTMISFCGVLVPYAQIVSFWRYWMYWINPFNYLMGSLLVFGLFDREVHCKEQEFAKFDAPNGTTCGEYLSEFMQTIGARMNLTNPEATEGCRVCEYTRGSDYLFTINLKDYYYGWRDAGIVALFVVSSYGLVFGLMKLRTKASKTAQ

SEQ ID NO: 11226 - protein, 491 aa, Populus tremula x Populus tremuloides
MATDKAVETVIVGNYVEMETEGKPKDMKARFSKFLWHGGSAYDAWFSCASNQVAQVLLTLPYSFSQLGMLSGICFQLLYGLLGSWTAYLISVLYIEYRTRKEREKVDFRNHVIQWFEVLDGLLEKYWRNVGLAFNCTFLLFGSVIQLIACASNIYYINDNLDKRTWTYIFGACCATTVFIPSFHNYRMWSFLGLVMTTYTAWYLTIASLLHGQVEGVKHSGPTKIVLYFTGATNILYTFGGHAVTVEIMHAMWKPQKFKAIYLLATLYVLTLTLPSAAAVYWAFGDMLLNHSNAFSLLPRSPSRDMAVILMLIHQFITFGFACTPLYFVWEKAIGMHECKSLCKRAAARLPVVIPIWFLAIIFPFFGPINSTVGSLLVSFTVYIIPALAYMFTFKSSAARENAVEQPPKYMGRWVGTYVMNSFVVVWVLIVGFGFGGWASVTNFVHQIDTFGLFTKCYQCPPPTMAPSLPHLNATAAPPPLHHGHNLTHSP

SEQ ID NO: 11227 - protein, 362 aa, Populus tremuloides
MSKSPEEEHPVKAFGWAARDQSGHLSPFNFSRRATGEEDVRFKVLYCGVCHSDLHSIKNDWGFSMYPLVPGHEIVGEVTEVGSKVKKVNVGDKVGVGCLVGACHSCESCANDLENYCPKMILTYASIYHDGTITYGGYSDHMVANERYIIRFPDNMPLDGGAPLLCAGITVYSPLKYFGLDEPGKHIGIVGLGGLGHVAVKFAKAFGSKVTVISTSPSKKEEALKNFGADSFLVSRDQEQMQAAAGTLDGIIDTVSAVHPLLPLFGLLKSHGKLILVGAPEKPLELPAFSLIAGRKIVAGSGIGGMKETQEMIDFAAKHNITADIEVISTDYLNTAMERLAKNDVRYRFVIDVGNTLAATKP

SEQ ID NO: 11228 - protein, 351 aa, Streptomyces coelicolor A3(2)
MTVDGPRSTAPDVVDVVALGESMVTFLPSRPGRLADVPSFDRAIGGAESNVACVLAAAGHSARWAGRVGADGFGDHLVEAIGAYGVDVSAVRRDPARPTGVYFRTAGDRATDAHEVAYYRAGSAASAMSVDTMDLDAIRSGRVLHLSGITPALSAGCLGLMRELTARRPGRPLVSFDVNHRPGLWRDARHGHGPEVLLELARGADLVFVGDDEARDAWGLGGPEAVRAALPEPELLVVKQGASGATAFHGTDATSVPALHVDVVAAVGAGDAFAAGFLSATLRGKPVRERLRHGHLWAAAALTVPADLAAPPARGHADRLVALDDTAWGRLRLGPGWTHAEEGAEEEVRTP

SEQ ID NO: 11229 - protein, 236 aa, Neurospora crassa
MVLMGPPGAGKGTQAPKIKEKFNCCHLATGDMLRAQVAKGTALGKQAKKIMNEGGLVSDDIVIGMIKDELENNKECQGGFILDGFPRTVPQAEGLDAMLRERNLPLQHAVELKIDDSLLVARITGRLVHPASGRSYHRIFNPPKDDMKDDITGEPLVQRSDDNAEALRKRLETYHKQTAPVVGYYQNTGIWKAIDASQEPAQVWKSLLAIFEGDKAKASSAGSGIMSKIASAAKSS

SEQ ID NO: 11230 - protein, 457 aa, Escherichia coli O157:H7
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRYLQRLPSAIILQRASR

SEQ ID NO: 11231 - protein, 458 aa, Bacillus halodurans
MKPTETLQEKGKLFLVVMMPILITQIGLYAMNFFDTVMSGQAGANDLAGVAIGSSLWVPVFTGLNGVLLALTPIIAQSIGAEKRDDVPYVFLQGLYLSIAISIAVILIGAVVLDPILSAMSLEDEVGRIAKEYLIGLAFGIVPLFIYTTIRCLIDSLGETRVTMFITLLSLPINIFFNYVLIFGKLGFPRLGGVGAGYASAITYWFILAVAIVVVVKVRPFTDFQLFKKLYHVSLKKWKEILLLGLPIGFTIFFETSIFAAVTLLMSTFDTATIAAHQAAVNFASFLYMIPLSIAFTLTIAVGYEVGAKRVEDARQYSRLGITFALIMGLVAGVIIYVLRAPVASLYTNDSQVAWLIQQFLIYSIFFQLSDALATPIQGVLRGHKDVNVPFVMALVSFWIIGLPTGYLLANFSPLGPYGYWIGLITGLASCAIALSWRLKQMQRKFERAARLSQNGNS

SEQ ID NO: 11232 - protein, 438 aa, Bacillus sphaericus
MRKTKIVCTIGPASESSETLEKLIEAGMNVARLNFSHGSHEEHAGRIHLIREVAQKLNKPVGILLDTKGPEIRTHNMKNGELHLTAGQVIDISMTEVEGTETSFSVTYEQLVEDVEQNSIILLDDGLIQLRVLATDVEKGLIHTIVENAGVLKNKKGVNVPGVSVQLPGITEKDAQDILFGIEQGVDFIAASFVRRAKDVLEIRELLEQNGGGHIQIIPKIENQEGVDNIDEIILVSDGLMVARGDLGVEIPAEEVPLVQKKLILKCNQVGKPVITATQMLDSMQRNPRPTRAEASDVANAIIDGTDAIMLSGETGAGLYPVESVQTMNKIAQRTENSLDYKSIVSTRSREKEANMTEAISQAVAYTSINLGVKAVLAPTESGNTARMIAKYRPGVPIVAVTGSTNTAQTLTLVWGVHPIVCQRVTTTDEILELAVDE

SEQ ID NO: 11233 - protein, 448 aa, Rhodococcus sp. 19070
MADNTTAWASPRHRRTVIWVVALATLAIIFDGYDLVVYGTILPTLMADPSQIGAISAQQGGALGSYALIGVMVGALFTGAFGDRLGRRKMMLINIVWFSVGMGAAAMATSITSFGILRFFTGIGVGGLVATAGAVVAEFAPPGKRNLFNAIVYSGVPAGGVLASLLAIVLRDTIGWRGLFWIGALPLVILLPLALVKLPESPMWLQARGRTDEAAAVCDKFGLPLPTIAPAPAEKVGFAALATRRYAWGTTLLGLMSFAGLLLTYGLNTWLPKIMADAGYNAKGSLAFLLVLNGGAIIGGLLASRIADGRGPQPVIATTFGLAGLALILLTFGFPLPVLLTAVAIAGVGTIGTQVLIYGFVSNYYETAARGAGVAWCAGFGRLGGIFGPIIGGLLIGAGLSNDVSFYIFAGIAVAGALVTVFVPIRRGAQYVARTPEAAAASPTTVEV

SEQ ID NO: 11234 - protein, 311 aa, Saccharomyces cerevisiae
MTASTPSNVMTLFLLRHGQSELNHENIFCGWIDAKLTEKGKEQARHSAELIEQYCKANNLRLPQIGYTSRLIRTQQTIETMCEEFKLKPQLQVVYDFNKIKLGDEFGSDDKDNMKIPILQTWRLNERHYGSWQGQRKPNVLKEYGKDKYMFIRRDYEGKPPPVDLDREMIQQENEKGSSTGYEFKEPNRQIKYELECSNHDIVLPDSESLREVVYRLNPFLQNVILKLANQYDESSCLIVGHGSSVRSLLKILEGISDDDIKNVDIPNGIPLVVELDKNNGLKFIRKFYLDPESAKINAEKVRNEGFIKNP

SEQ ID NO: 11235 - protein, 2145 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRNVPVDSTILGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLFLVDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPVGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 11236 - protein, 341 aa, Trifolium repens
QTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGIPVETLVKLVPEHARKQCPFLGL

SEQ ID NO: 11237 - protein, 252 aa, Geobacillus stearothermophilus
RKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 11238 - protein, 391 aa, Streptococcus criceti
MKFETSHLLKKLPKQFFADLVTKVNAKIAQGADVINLGQGNPDRPTYDFIVKALQDSAAKPASHKYSLFRGNPPFKEAAADFYKANYQVDLDSQTEICVLGGSKIGLVELPWALMNPGELLLLPDPGYPDYLSAVALGQVDCETYPLLAENDFLPDLTAIPEESARRAKFIYINYPNNPTGAVATPAFYESLVDWAKKYEVGVVSDFAYGALGYQGYKNPSFLSTPGAKDVGIELYTFSKTFNMAGWRLAFAAGNADMIEALNLIQDHLFVSIFPAIQDAGVAALSDPRAKEAIAALNQRYDQRREAFVQAAAQIGWQAFPSKGSFYAWMPVPEGFNSQNFADLLLEEAHVAVAPGIGFGQEGDSYVRIGLLVEPDHLAQAVERIGQLDLF

SEQ ID NO: 11239 - protein, 1035 aa, Saccharomyces cerevisiae
MPVEFATNPFGEAKNATSLPKYGTPVTAISSVLFNNVDSIFAYKSFSQPDLLHQDLKKWSEKRGNESRGKPFFQELDIRSGAGLAPLGFSHGLKNTTAIVAPGFSLPYFINSLKTVSHDGKFLLNVGALNYDNATGSVTNDYVTALDAASKLKYGVVTPISANEVQSVALLALAIATFSNNSGAINLFDGLNYSKTVLPLVESVPEASILAKLSKVIAPDAAFDDVLDKFNELTGLRLHNFQYFGAQDAETVFITYGSLESELFNSAISGNNSKIGLINVRVPLPFNVAKFVTHVPSTTKQIVVIGQTLDGSSPSFLRSQVSAALFYHGRTSISVSEYIYQPDFIWSPKAVKSIVSSFIPEFTYNADSSFGEGFIYWASDKSINIDVASKLVKALSLEDGKFVSLRTKFDNLANAGTFQAQFVTSKEQIPVSNIDSTKLSVVEDVSLLKHLDVAATVAEQGSIALVSQKAVKDLDLNSVESYVKNLGIPESFLISIAKKNIKLFIIDGETTNDESKLSLFIQAVFWKLAFGLDVAECTNRIWKSIDSGADISAASISEFLTGAFKNFLSEVPLALYTKFSEINIEKKEDEEEPAALPIFVNETSFLPNNSTIEEIPLPETSEISDIAKKLSFKEAYEVENKLRPDLPVKNFVVKVKENRRVTPADYDRYIFHIEFDISGTGMTYDIGEALGIHARNNESLVKEFLTFYGLNESDVVLVPNKDNHHLLETRTVLQAFVENLDIFGKPPKRFYESLIPYASNEEEKKKLEDLVTPAGAVDLKRFQDVEYYTYADIFELFPSVRPSLEELVTIIEPLKRREYSIASSQKVHPNEVHLLIVVVDWVDNKGRKRYGQASKYISDLAVGSELVVSVKPSVMKLPPSPKQPVIMSGLGTGLAPFKAIVEEKLWQKQQGYEIGEVFLYLGSRHKREEYLYGELWEAYKDAGIITHIGAAFSRDQPQKIYIQDRIKENLDELKTAMIDNKGSFYLCGPTWPVPDITQALQDILAKDAEERGIKVDLDAAIEELKEASRYILEVY

SEQ ID NO: 11240 - protein, 340 aa, Saccharomyces cerevisiae
MIDRTELSKFGITTQLSVIGRNPDEQSGFVNPPLYKGSTIILKKLSDLEQRKGRFYGTAGSPTIDNLENAWTHLTGGAGTVLSASGLGSISLALLALSKAGDHILMTDSVYVPTRMLCDGLLAKFGVETDYYDPSIGKDIEKLVKPNTTVIFLESPGSGTMEVQDIPALVSVAKKHGIKTILDNTWATPLFFDAHAHGIDISVEAGTKYLGGHSDLLIGLASANEECWPLLRSTYDAMAMLPGAEDCQLALRGMRTLHLRLKEVERKALDLAAWLGNRDEVEKVLHPAFEDCPGHEYWVRDYKGSSGLFSIVLKNGFTRAGLEKMVEGMKVLQLGFSWGG

SEQ ID NO: 11241 - protein, 464 aa, Klebsiella oxytoca
MKTFPQAFLWGGATAANQVEGAYLEDGKGLTTSDVQPRGVFGDVVERVPGDSGIKDIAIDFYHRYPEDISLFAEMGFNCLRVSIAWARIFPHGDEAQPNEAGLAFYDKLFDEMAKHNITPLVTLSHYEMPWALVKNYGGWGNRKVIGFFERYARTVFERYQAKVKLWLTFNEINMSLHAPMTGVGLPADSSKAEVYQAIHHQLVASALAAKACHDIVPEGKIGNMLLGGLMYPLSCKPDDIFETLQQNRSWQFFGDVQCRGAYPGYMLRYFRDNGINLDITDADRAALKETVDFISFSYYMTGCVTADEELNKKARGNILSMVPNPHLASSEWGWQIDPLGLRTLLNVLWDRYQKPLFIVENGLGAKDKVEADGSINDDYRISYLNDHLVQVREAIEDGVELMGYTSWGPIDLVSASKAEMSKRYGFIYVDRDDDGNGTLARSRKKSFWWYKEVIATNGGSLKE

SEQ ID NO: 11242 - protein, 480 aa, Thermoplasma volcanium GSS1
MNRMQKIFSLTISFKLSCLGMGYYDDMRHDDLNYEYLYGSTYPLMKNAGSSVAKVIEKNFASGQKVCVVCGTGNNAGDAIVAAELLRTKFEVTVLLVNGLKSELAKKALQEYGGNVVDASHIDECLAADIIIDGIFGVGISGEPKEPYKSTIEKINASGKKIVSVDVPSGLGTNCAVRPDITVTFTSLKYGMNKENSGEIIVADIGIPDDVRKYAGPGDLIYYPRPDPDSHKGMNGTLGIVAGWEYHGSSVIAALAAENLGLDLVRIYVTNKNYEIVSSYDPGIIVRLFDYKRQASYEEVWRNSALLIGPGLGTSHEAEIALKRLVNGSAVPIVIDADGITLLSKHLSIIKGKKIVVTPHKNEFRKLTGTEPNEENAVEFAKEKGIIIVLKGKVDIITDGKEVHYAKGGNARMTMGGTGDLLAGLISSFISKGIDPMRSCLMGTYLNKRIGELAYDKKGLFYKITDMIDEIPSVMASYVR

SEQ ID NO: 11243 - protein, 394 aa, Thermoplasma volcanium GSS1
MNKVRMAEKRLFNGFNTRAVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDKASES

SEQ ID NO: 11244 - protein, 264 aa, Thermoplasma volcanium GSS1
MWRQNMEKAMWYGIGKRMYKDLDSRYIEIFEMLRMGRTPELDGEGKKPDLRSLLIEYGNYRIKQEFTEDQAAIKVAAVREEMDQLINKYYEKCLAFAIPFDLKVTSDPCAYFRQGSTIDGISELFSYGSKMCDFRGQLDERVKEMARQILPNTTALVGERLAMDLLVHAHGLKRLAYMPSSSIQMLGAERALFTAIQKRGNTPKYGVLFKYPKLSTLRPRQRGKIARIIANKVAITARADLLGTKVDAESFREKIDNMIKSSKK

SEQ ID NO: 11245 - protein, 469 aa, Thermoplasma volcanium GSS1
MYIRLVQYPSTGSGTGCTNIGGIWMGFFDDMDRMGIRPFHRKIEILASMGMFLDGYDLSVITMAILLMPTQLHFGKLDYILVNVSAFIGMIIGAPLLGRLSDRIGRKKIFGIDLLLFVVFAITAGLATNFAMLFISRLMLGIGIGGDYPISSTMVSEFSPVSKRGTLLYGMVGMYWLGSFFSAVMNYTFAFTPYFWRYTFIVGGVIAIPIIFLRMRIPESPRWLIGHGMTKSAESVVEDLTGRKPDVEEGKAEAEQEESVKFSSLFSSKFLASTIFVLSVWFLFDVASYGIGFYYPTLIDKLGLASHVLNTAGLRAIAESSMIVAVGAILGYLVAMPLADRIGRRILTISGLFVMFLLLLLGSVVKISTLLPVVAFFFSFVLFEQWVGAATLFYPTELFPTNYRSTIQGIATSVSRVGAIMGIVVFPLYPVFHSIFIFAILMALALIISVIFAPETKKTPLEKIWKSKA

SEQ ID NO: 11246 - protein, 420 aa, Thermoplasma volcanium GSS1
MEDMLLNEEEKQIRDLCRRVVKEVPHELIRKIEREEVTFPREFIDFITKNGVVGLRFPKEYGGKGASWVAEASAVEEMGYLGFTLSCMYSLGTIVGEPMYRYGTNEQKEKYLKGITSGKLYGAEAITEPSGGSDLFGMMKTTAVKKGNKYILNGQKRFIVGGKGADFFVTYAITDPNAKSRTRGISAFIVDRDTPGLKVETLYGLMGNKGGGTARIVYKDAEVPEENLIGELNGGYEVFNRMMIPERLTTAAGSLGVSTAALKVATDYALKREAFGSKLIEHEGINFKLAESLTLLQSASALVYTAAKAADLYEKGQTTQSYARKLVSMAKLHSTEAMWKIVNDAMQIMGGIGYTTVYPIERLLRDSRLGLIWTGSSEVMKMIIQHEYLKEFTNPDYWESRRDIEKDALDFRLEEEKVFK

SEQ ID NO: 11247 - protein, 351 aa, Thermoplasma volcanium GSS1
MNPGCRLRGPMGYPDYLTGPLSLSCINIKTKRNIQKAYFRMFDVNPMPIDPQVRKYLDAMSKVSVPELNKTPIEDLRKIFDTPASGAPKVKISVVEDMILDTDAAKLPARLYDDSNSDSLVLYFHGGGFVFGSIETHDSLCRRIAKYSGSKVISVGYRLGPENKFPVAQIDAFNSYLYVLKRSEELGVDSDKIALMGDSAGGNLAAVASLMARDKGIKLPRLQVLVYPSTGPDMTSKSYLEYSSIYLTKELLNWFSSQYLNSIEDALNPYFSPILADLSGLPEAIVVTDEYDPLLEQGETYSATLRDSGVPVTSIRVNGMIHGFLSNFHLFRAADVSLMMISGAIHTILES

SEQ ID NO: 11248 - protein, 368 aa, Thermoplasma volcanium GSS1
MPIKDRFDDHAHSLSFPVFFTSSYDSRKDRKYRYSRELNPTVEELSRQLSLLENTERSICFSSGMGAITGTILALAKPGDKLVMPTDVFGRTYLFAKNFLTKFGINVKFVEPGTDSLLGAVEEHADIVFFESLSNPLLRLYDVDRICRKASDIGAITIVDNTLATPILLKPSLYGCDIIIESLSKFIGGHNNAIGGSASGSLMMDTIDENRRSLGSSMDPMSAYLFILGLKTIDLRIKRSSETAKAIARFLNENNFVSKVYYPGLSDNSDNISAKTLLNGSPPIVSFLLDEGKDVQKFMESLRIITPANTMGGSNSTISNPYTMSHRNLSEDEKLRLGITKNLMRLSVGLEDLDQIIQDLEQAIKYAQ

SEQ ID NO: 11249 - protein, 304 aa, Thermoplasma volcanium GSS1
MLPNFLPVGEIRKLAASVLPDINIITDLDFKSDESDILIVTAFTKVDKALLDKFPRLKFIQVASTGYDNVDVTEVKSRNILMCNSPSSNKESVAEHVIGMALYFLKDFGHLDREIRNGNWPILTFSRDLMGKVFGIIGMGAIGRKLAERLIQFGVGIIYYDVKRLPEEVEDELGITYVTLDELISSADIISIHVPLTETTKGMIGRKEFEKMKDGCIFINTSRAEVVVTKDLVWALKQGKIKAGIDVYDREPPDFSSELFQMDNALFSPHIAGVTVESQRRFIEETVANVIRYMQGVDPLNRVL

SEQ ID NO: 11250 - protein, 395 aa, Thermoplasma volcanium GSS1
MGNMKMFNIASEDDIKKGLASDVYFERSISTLTETCKDHRVAMEATVSGPLDTWINFSGLDEVLKLLEGIDVDVFAIPEGTILYPRDSNGIPVPFIRIEGNYCDFGMYETSILGMICQASGISTKSSKVRIAAGDCPFFSFGIRRMHPAVSPMIDRSAFIGGADGVSGILGAKLIGEEPIGTMPHALSIILGDDEAWRLTLKNTKNGQKSVILIDTYMDEKFAAIKVAEEFEHVDYIRLDTPSSRRGNFEALVREVKWELALRGRSDIKIMVSGGLDENTVAKLREAGAQAFGVGTSISSAKPFDFALDIVSIDDKPKTKRGKLSGKKSVLRCEKCRKVEVVPYGVESKPCSCGGVMHNIIVKYMEHGKLLSQYPEPKEIRKRTLSELEYFRSSN

SEQ ID NO: 11251 - protein, 500 aa, Thermoplasma volcanium GSS1
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 11252 - protein, 376 aa, Thermoplasma volcanium GSS1
MSQQKIEVIKMLCLSEEQSIIKGSIAEFTKRRIEPIEKRIEDDDYFPMDILREIGKNGFFSVMLPGIGVQDTYSFSLIAEEISKVSPEVAWLYVTHVAASYALDKLGTEEQKDSYLRKMADGEIIGTIAITESSSGATASAIASSARKYEENWILEGSKTFITMGGDADLYAVLAKTHEDPAAFTTFIVLKSDVGLELGTHLIGSAMKGIGWGEISFNNLILEKHRILGKENEGIKIIPTIARIFSIGAASISLGIMERALELVSSHVKERKIACKSLLSNQTVQDKLFHLYADTEAARSLVYRASINDDIRLAYSAKLFSTERSIAVTESAVSLFGATGYEESLAIPKLLNKAIAVPLHFINNAILTGLFITAID

SEQ ID NO: 11253 - protein, 462 aa, Thermoplasma volcanium GSS1
MSYFKNKNINDECSYATMPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 11254 - protein, 124 aa, Cucumis sativus
GRGQFGTTFLCTDKPTGFNYACKTIPKRKLLCKEEYEDVWREIQIMHHLSEHPNIVRIKGTYEDPGLCYLVMELCEGGELFDRIVQKGQYSEREAAKLIGVIVSVLESCHSLGVMHRDLKPENF

SEQ ID NO: 11255 - protein, 124 aa, Cucumis sativus
GRGQFGTTFLCLEKSTGKEYACKSIAKRKLATMEDVEDVRREIQIMHHLVGIPSIVSIKGAYEDAVAVHVVMELCEGGELFDRIVKLGHYTERQAAELARTVIGVIEACNSLGVMHSDLKPENF

SEQ ID NO: 11256 - protein, 124 aa, Cucumis sativus
GRGQFGTTYLCTYRPTGDLYACKSIPKRKLLCKEDYEDVWREIQIMHHLSEHPNVVQIKGTYEDSVFVHLVMELCAGGELFDRILLKGHYSEREAAQLIKTIVGVVETCHSLGVMHRDLKPENF

SEQ ID NO: 11257 - protein, 124 aa, Cucumis sativus
GRGQFGTTYLCTEITTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENF

SEQ ID NO: 11258 - protein, 1436 aa, Nicotiana plumbaginifolia
MEPADLSNLRGRSLRASIRGSMRGSIRENSNSIWRNNGAEVFSRSARDEDDEEALKWAALEKLPTYDRLRKGILFGSQGAAAEVDVDDSGVLERKNLLERLVKVADEDNEKFLLKLKNRIDRVGIDFPSIEVRFEHLNIDADAYVGSRALPTFTNFISNFVEGLLDSIHILPSKKRQVTILKDVSGIVKPCRMTLLLGPPGSGKTTLLLALAGKLDSALKVTGKVTYNGHELHEFVPQRTAAYISQHDLHIGEMTVRETLEFSARCQGVGSRYEMLAELSRREKAANIKPDADIDMFMKAASTEGQEAKVVTDYILKILGLDICADTMVGDQMIRGISGGQKKRVTTGEMIVGPSKALFMDEISTGLDSSTTYSIVNSLKQSVRIMKGTALISLLQPAPETYNLFDDIILLSDGYIVYEGPREEVLEFFESMGFKCPERKGAADFLQEVTSKKDQQQYWIRRDEPYRFITSKEFAEAYQSFHVGRKVSDELKTTFDKSKSHPAALTTQKYGIGKRQLLKVCTERELLLMQRNSFVYLFKFFQLLIIALMTMTIFFRTKMPRDSAEDGGIYSGALFFVVIMIMFNGLSELPMTLYKLPVFYKQRDFLFYPSWAYAIPSWILKIPVTFAEVGMWVFLTYYVMGFDPNVGRFFKQFLLLLLVNQMASALFRFIAAVGRTMGVASTFGAFALLLQFALGGFILARNDVKDWWIWGYWTSPLMYSVNAILVNEFDGQKWKHIVAGGTEPLGAAVVRARGFFPDAYWYWIGVGALAGFIVMFNIAYSVALAYLNPFDKPQATISDESENNESESSPQITSTQEGDSASENKKKGMVLPFDPHSITFDEVVYSVDMPPEMRESGTSDNRLVLLKSVSGAFRPGVLTALMGVSGAGKTTLMDVLAGRKTGGYIDGSIKISGYPKKQDTFARISGYCEQNDIHSPYVTVFESLVYSAWLRLPQDVNEEKRMMFVEEVMDLVELTPLRSALVGLPGVNGLSTEQRKRLTIAVELVANPSIIFMDEPTSGLDARAAAIVMRAVRNTVDTGRTVVCTIHQPSIDIFEAFDELFLMKRGGQEIYVGPLGRQSCHLIKYFESIPGVSKIVEGYNPATWMLEVTASSQEMALGVDFTDLYKKSDLYRRNKALIDELSVPRPGTSDLHFDSEFSQPFWTQCMACLWKQHWSYWRNPAYTAVRLIFTTFIALIFGTMFWDIGTKVSRNQDLVNAMGSMYAAVLFLGVQNSSSVQPVVSVERTVFYREKAAGMYSAIPYAFAQVLIEIPYIFVQATVYGLIVYSMIGFEWTVAKFFWDFFFMFFTFLYFTFFGMMTVAVTPNQNVASIVAGFFYTVWNLFSGFIVPRPRIPIWWRWYYWGCPIAWTLYGLVASQFGDLQDPLTDQNQTVEQFLRSNFGFKHDFLGVVAAVIVAFAVVFAFTFALGIKAFNFQRR

SEQ ID NO: 11259 - protein, 432 aa, Kluyveromyces lactis
MVYEAKPFDPITVKANEKKRVAYFYDADVGNYAYGAGHPMKPHRIRMTHSLIMNYGLYKKMEIYRAKPATKQEMCQFHTDEYIDFLSRVTPDNLDMFQKESVKFNVGDDCPVFDGLYEYCSISGGGSMEGAARLNRGKCDVAINYAGGLHHAKKSEASGFCYLNDIVLGIIELLRYHPRVLYIDIDVHHGDGVEEAFYTTDRVMTCSFHKYGEFFPGTGELRDTGVGKGKYYAVNVPLRDGIDDATYKSVFEPVIGKIMEWYQPSAVVLQCGGDSLSGDRLGCFNLSMKGHANCVNYMKSFGVPLMIVGGGGYTMRNVARTWAFETGILNNVILDEELPYNDYYEYYGPDYKLDVRPSNMYNVNTPEYLDKVLLNIFSNLKHTKYAPSVQLNHVPRDAEDKGDAEEDTAAAKDTRGGSQYARDITIENATEF

SEQ ID NO: 11260 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHSIDRTYDVAEKVWAEVFFYLAQNNVMFEGILLKPSMVTPGAEATDRATPEQVASYTLKLLRNRIPPAVPGIMFLSGGQSGLEATLNLNAMNQAPNPWHVSFSYARALQNTCLKTWGGKEENVKAAQDILLARAKANSLAQLGKYTGEGESEEAKEGMFVKGYTY

SEQ ID NO: 11261 - protein, 41 aa, Bacillus megaterium
AAAVEKFNLADKMSHISTGGGASLEFMEGKELPGVVALNDK

SEQ ID NO: 11262 - protein, 134 aa, Solanum tuberosum
DEYGNPVRQTDEYGNPIQQTGGTMGEYGTTGTGYGTQAGHTTGVLGGEQRQHGTLGGMLHRSGSSSSSSSVSEDDGHGGRRKKKGIKDKIKEKLPGGHRDDLAHSTATTTTTGYGMEGTHEKKGIMEKIKEKLP

SEQ ID NO: 11263 - protein, 285 aa, Nectria haematococca mpVI
TLQQEKEEAGDKKGGPNATTTLVEKYGKCQEVVGRGAFGIVRISHKKVGGGGEKLFAVKEFRRRPEETEKKYSKRLTAEFCISSSLRHPNVIHTLDLLKDAKGDYCEVMEFCAGGDLYTLVLSSGKLEVQEADCFFKQMMRGVEYLHEMGVAHRDLKPENLLLTTRGALKITDFGNGECFRMAWETDAHMVSGLCGSAPYIAPEEYTDKEFDARAVDVWACGCYLHGNAHWSSLWRLPRRMTTNSMPAILKVAEMKRVTALSSPFIGLVVVMSSTRFLTPTRLAA

SEQ ID NO: 11264 - protein, 338 aa, Pseudomonas fluorescens
MNLNRFKRYPLTFGPSPITPLKRLSEHLGGKVELYAKREDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMNDVVERGGKPFPIPAGCSEHPYGGLGFVGFAEEVREQEKQLGFKFDYIVVCSVTGSTQAGMVVGFAADGRSKNVIGIDASAKPEKTKAQILRIARHTAELVELGREITEDDVVLDTPFAYPEYGLPNEGTLEAIRLCGSLEGVLTDPVYEGKSMHGMIEMVRRGEFPEGSKVLYAHLGGAPALNAYSFLFRNG

SEQ ID NO: 11265 - protein, 248 aa, Gossypium hirsutum
MAGIAFGRFDDSFSLGTVKAYLAEFISTLVFVFAGVGSAIAYNKLTTDAALDPDGLVAIAVCHGFALFVAVAIGANISGGHVNPAVTFGLALGGQITILTGIFYWIAQLLGSIVACFLLKAVTGGLTVPIHGLGAGVGAIQGVVMEIIITFALVYTVYATAADPKKGSLGTIAPIAIGFIVGANILAAGPFSGGSMNPARSFGPAVASGDFNGIWIYWVGPLIGGGLSGLIYGNVFMNSDHAPLSNDF

SEQ ID NO: 11266 - protein, 121 aa, Corynebacterium glutamicum
LEGVSAASKGYIYAISRDGVTGTERESSTDGLSAVVDNIKKFDGAPILLGFGISSPQHVADAIAAGASGAITGSAITKIIASHCEGEHPNPSTIRDMDGLKKDLTEFISATEGSDQEGLGL

SEQ ID NO: 11267 - protein, 1426 aa, Mycosphaerella graminicola
MTLQRSSSWGVQTGTGEEVYRTLSRTFSNRPKEETYPESTSSSDDSTKKAADWGLTEELKQTQQQNENDGAKDKKLGITWTDLDIKGIGADAAFAENVISQFNIPKKIKEGRQKPPLKTIVDKSHGCVKPGEMLLVLGRPGAGCTSLLKILANRRLGYAEIDGDVKYGSMDHKQAQQYRGQIVMNTEEELFFPTLTVGQTMDFATRMKVPYNVPSNFSSAKELQQAQRDFLLKSMGIEHTDDTKVGNEYVRGVSGGERKRVSILETMAARATVVCWDNSTRGLDASTALEYTRCVRAMTDVLGLSSIVTLYQAGNGIYELFDKVLVLDEGKEIFYGPMSQAKPFMEDLGFVCTDGANVADFLTGITVPTERRIRDEYEDRFPRNADEVRAAYQKSNIKARMEQEYDYSDTEEAKTCTQTFCEAVQAEKHKSLPKKSPLTTSFYTQVQTSVIRQYQLLWGDKATFFIKQISTVSQALIAGSIFYNAPANSSGLFIKGGALFFSLLYNALVAMNEVTDSFSARPILAKHRGFAYYHPAAFCVAQITADIPIIIVQVTLLSLPMYWLTGLKPTAAAFFTYWAILFATSMAITAFFRMIGAGCATFDAASKVSGFAVSALIMYTGYMLPKPNMHPWFVWIYWIDPLAYGFEALMGNEFSNQVIPCANNNLVPNGPGYADSAFQACTGVRGAPRGSTIVTGEQYLDSLSYSPSNVWRNFGVLWAWWLLFVALTIYFTSNWSQVSGNSGFLVIPREKAKKAAHLMNDEEAQPAGMSEKKTAEDKEKDGNVDSQLIRNTSVFTWKGLTYTVKTPTGDRVLLDDVKGWVKPGMLGALMGSSGAGKTTLLDVLAQRKTEGTIKGSILVDGRDVPISFQRSAGYCEQLDIHEPLATVREALEFSALLRQPRDVPREDKLKYVDTIIDLLEMHDIENTLIGTTYAGLSVEQRKRLTIGVELVSKPSILIFLDEPTSGLDGQAAFNIVRFLRKLADVGQAVLVTIHQPSASLFAQFDTLLLLAKGGKTVYFGDIGDNGQTVKDYFGRYDAPCPKNANPAEHMIDVVSGTLSKDKDWNRVWLDSPEHSAMTTELDRIVSDAASKPPGTLDDGREFATSLWTQIKLVTNRNNISLFRNNDYTDNKFMLHIGSALFNGFTFWQIGNSVQDLQLRLFALFNFIFVAPGVIAQLQPLFLERRDLYEAREKKSKMYHWSAFVTGLIVSEIPYLVVCAVLYFVCFYYTVGFPAASSSAGAVFFVMLFYEFIYTGIGQFVAAYASNALFAFLINPFIISMLALFCGVLVPYAQIQPFWRYWFYYLNPFNYLMGSLLVFTTWNVPVTCKTSELAVFDTPNAGQTCQEYLAGFLQGMGRTSNLLNPQATSGCEVCQYRTGADYLYGLNLTKKSDGWRDAGIVVLFAFSSYGCVYLLMKLRTKASKKAE

SEQ ID NO: 11268 - protein, 1321 aa, Mycosphaerella graminicola
MATDSSSRSASRSRFRDWDAIFLPDLSPTPTTVAFEGKLPKPNAMVPVPTVASAVLSTITLPWRVGQRLFRRTHETPRKPIFSLFVRPGEMVLVASAEPAECTQLLRAIVRHVSYPGVAVFCSADDVHPHVLTVEQLLRFRLRARAVRSPSAEDDAVELLLRLFRIESIRNTLIGNAVVRGISGGERRRLSVAEALLSGANVLCFDDLTRGLDAAIALHCVQCLRSVADAYRLTIFASLSAASDTIYATFDQLVAIRDGHQVFGGPPTAVRPCGDDAQTQPAPPLASYFDHLHARIAPRASSPTAHDMADAFRRSAHYADTAVCLATYLAEEQASSGSSNQSPRHHQKRHAMNRKVVALLQRQMLLAWKDRFALTVSWILFLVLGCTIGLACFQLQRTGAGAQARGGLLYTCVLGIAVSAQVEVAKTTLGRPLLRKVFAYRFERPAAFWTAQIAVDTMLESMRVFIFAICVYFLTALHRTAPAFLYFLAVLLLLYMCNVLMNRAIGCMCRSFDSAIRTATFVFVFYMITAGYIVSQATQPSWLKWTYYLNPLALAFSALMMNEFEHITIDCQSSVLSFPPTRPLPVNALQSGVTCGLATSADRTFLVAGGTYLQLDFDYDTHDKVRTILNLLALVGLFFIANLALAEILDWDSPASSVMVSVPKNIQPPQQTRTACMTAFVPTPPTSEFVQSPAAWTRGVSRLTFCRLRYDIATERGQQSRRLLDEVTGVLESGQLLAVMGASGAGKTTLLNLLSGREHSGVRGGTVSACTSRGLPPTIGYAEQVDIHEPKSTVREAMLFSACLRQPKHVSFAEKRAWVDHLIPLLELTPIQNAIIGVVGSGSELSARDRKRTTIAVELAAKPDILFLDEPTTGLGSEGALAIARLLRKLADHGQAIACSIHQPSASTLENFDQVLFLHNGKMVYFGPLGSGLCRPAEYIARQTCSSCPVGRDPVEWMTTQVIGSSPAHHETWSDAWASSEEADMLQASLKPTSYSETSRAESMRGHPCQASVWYQIHQLTLRNSTALWRTPEYGFSRFINHVALAVTIRIVLPHAGHSIRDMVHRVLALWQTTMLPAFILTTVEYRFHASRRLSLRESATSTYSNTALAVSAMLVEIPYCFLCTAGFVLPLFSLVGPLVLSQVTYFALAVFLVQIFCVTLAQAIATLSPYERISTLFNTPSITVFALFCGISVPRSELPGFLRNWLYYLNPYTWLMSGLLTNSIHGFNVQCAGNELTDITVPLPQTCQQAMSLLSTLHDPGYIAGNTSEVCHYCPLTTGDRYSESLGLSYAQRWKYLGVFSVFCVSNVGLILLAQQFRRR

SEQ ID NO: 11269 - protein, 473 aa, Nicotiana tabacum
MQFFSLVSIFLFLAFLFLLRKWKNSNSQSKKLPPGPWKIPILGSMLHMIGGEPHHVLRDLAKKYGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALEDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPTGIMPRDLDLTELSGITIARKGDLYLNATPYQPSRE

SEQ ID NO: 11270 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 11271 - protein, 438 aa, Alternaria alternata [sequence omitted]

SEQ ID NO: 11272 - protein, 334 aa, Schizosaccharomyces pombe
SSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLS

SEQ ID NO: 11273 - protein, 443 aa, Clostridium saccharobutylicum
MAKYTKEDIINLVKENGVKFIRLQFTDIFGTLKNVAITDKQLEKALDNECMFDGSSIDGFVRIEESDMNLRPNLDSFVIFPWRPQQGKVARLICDVYKPDGTPFEGDPRHVLKRANADAKELGYTMNVGPECEFFLFETDENGRATTNTQDKAGYFDLAPTDLGENARRDMTLALEEMGFEIEASHHEVAEGQNEIDFKYGDALTTADNIMTFKLVVKSIAQRHGLHASFMPKPIFGINGSGMHVNMSLFKDGKNAFVDENDKNGLSKVAYQFIAGLLKNIKGMAAVTNPLVNSYKRLVPGYEAPVYLAWSCKNRTALIRVPAARGAGTRVELRCPDPSSNPYLVLACLLQAGLDGIKNNLQPPAEVEANIFAMTEQERKENGIDNLPNNLYEAVNYMKENELAKKALGDHVYGNYVAGKAAEWDDYRTKVHDWELENYLNKY

SEQ ID NO: 11274 - protein, 208 aa, Lycopersicon esculentum
NSARAQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYVGASNLSEGASESLHVKDYKY

SEQ ID NO: 11275 - protein, 464 aa, Lycopersicon esculentum
MATCGIDWKSVLPNCFKGNNVRSEAKVMENSKQMNSDHHRLAFSDISTDSRSVLISLDDLSSNAVIGSNLHVFTYEELKLITSDFSSANFLGKGGFGPVHKGFIDDKIKPGLDAQPVAVKLLDLDGNQGHQEWLTEVVFLGQLRHHHLVKLIGYCWEEEQRLLVYEYMARGNLEDQLFSRYSSCLPWLTRIKIMVGAAKGLAFLHGEEKPVIYRDFKASNILLDSDYRAKLSDFGLAKDGPEGDDTHVSTRVMGTHGYAAPEYIMTGHLTSKSDVYSFGVVLLELITGRRAMDKKRPLKERILVDWARPMLRDPHKLDRIMDPRLEGQYSTQGAKKVAALAYQCLSHHPRSRPTMSNIVKILEPVLDMKDIPMGPFVYVVPSSKPDKGTEIGELKTKVNDENKAGVRENEVDNAGENREDGNAKQRRVGHRYKHRLKTDASVYSDTHLYHKTVKHERTNKLNSY

SEQ ID NO: 11276 - protein, 132 aa, Lotus corniculatus
PLKYYGLDKPGLHVGVVGLGGLGHMAVKFAKALGAKVTVVSTSPNKKTEAIEKLGADSFVVSPEQDQMKAVMGTFDGIIDTVSAVHPLLPLISLLKPHGKLVMVGAPEKPLEVPVFSLLGGRKTIAGSMIGG

SEQ ID NO: 11277 - protein, 408 aa, Pseudomonas sp. KKS102
MSQEALKAPVVVLGAGLASVSFVAELRQAGYQGLITVVGDEAERPYDRPPLSKDFMAHGDAEKIRLDCKRAPEVEWLLGVTAQSFDPQAHTVALSDGRTLPYGTLVLATGAAPRALPTLQGATMPVHTLRTLEDARRIQAGLRPQSRLLIVGGGVIGLELAATARTAGVHVSLVETQPRLMSRAAPATLADFVARYHAAQGVDLRFERSVTGSVDGVVLLDDGTRIAADMVVVGIGVLANDALARAAGLACDDGIFVDAYGRTTCPDVYALGDVTRQRNPLSGRFERIETWSNAQNQGIAVARHLVDPTAPGYAELPWYWSDQGALRIQVAGLASGDEEIVRGEVSLDAPKFTLIELQKGRIVGATCVNNARDFAPLRRLLAVGAKPDRAALADPATDLRKLAAAVAA

SEQ ID NO: 11278 - protein, 165 aa, Lupinus angustifolius
GPLGSMDSPPEGYRRNVGICLMNNDKKIFAASRLDIPDAWQMPQGGIDEGEDPRNAAIRELREETGVTSAEVIAEVPYWLTYDFPPKVREKLNIQWGSDWKGQAQKWFLFKFTGQDQEINLLGDGSEKPEFGEWSWVTPEQLIDLTVEFKKPVYKEVLSVFAPHL

SEQ ID NO: 11279 - protein, 304 aa, Anabaena
MTQAKAKHADVPVNLYRPNAPFIGKVISNEPLVKEGGIGIVQHIKFDLTGGNLKYIEGQSIGIIPPGVDKNGKPERLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 11280 - protein, 304 aa, Anabaena
MTQAKAKHADVPVNLYRPNAPFIGKVISNEPLVKEGGIGIVQHIKFDLTGGNLKYIEGQSIGIIPPGVDKNGKPESLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 11281 - protein, 304 aa, Anabaena
MTQAKAKHADVPVNLYRPNAPFIGKVISNEPLVKEGGIGIVQHIKFDLTGGNLKYIEGQSIGIIPPGVDKNGKPEQLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 11282 - protein, 334 aa, Candida tropicalis
SDVPTTLINEGPSYAADIVVGSNQQKQTVVIDTGSSDLWVVDTDAECQVTYSGQTNNFCKQEGTFDPSSSSSAQNLNQDFSIEYGDLTSSQGSFYKDTVGFGGISIKNQQFADVTTTSVDQGIMGIGFTADEAGYNLYDNVPVTLKKQGIINKNAYSLYLNSEDASTGKIIFGGVDNAKYTGTLTALPVTSSVELRVHLGSINFDGTSVSTNADVVLDSGTTITYFSQSTADKFARIVGATWDSRNEIYRLPSCDLSGDAVFNFDQGVKITVPLSELILKDSDSSICYFGISRNDANILGDNFLRRAYIVYDLDDKTISLAQVKYTSSSDISAL

SEQ ID NO: 11283 - protein, 148 aa, Brassica rapa subsp. pekinensis
MGIIRKKHNKKSRRPSFKSVLTSILATQAAIFLLLLAGVSLAGTAVAFIASMPLFVVFSPILVPAGVATGLLATGLAAAGSSGAMAVSLILWVFKRVTGKEPPKIMSKVLRKVFPGGGTHLNWQQNQKPSQRRPAAAPSAAPAAAPST

SEQ ID NO: 11284 - protein, 206 aa, Brassica rapa
MSNEYDYLFKLLLIGDSSVGKSCLLLRFADDAYIDSYISTIGVDFKIRTIEQDGKTIKLQIWDTAGQERFRTITSSYYRGAHGIIIVYDCTEMESFNNVKQWLSEIDRYANDSVCKLLIGNKNDMVESKVVSTETGKALADELGIPFLETSAKDSTNVEQAFLTIAGEIKKKMGSHTNANKTSGSGTVQMKGQPIQQNNGGGCCGQ

SEQ ID NO: 11285 - protein, 280 aa, Thermus thermophilus
MAAKKDYYAILGVPRNATQEEIKRAYKRLARQYHPDVNKSPEAEEKFKEINEAYAVLSDPEKRRIYDTYGTTEAPPPPPPGGYDFSGFDVEDFSEFFQELFGPGLFGGFGRRSRKGRDLRAELPLTLEKAFHGGERVVEVAGRRVSVRIPPGVREGSVIRVPGMGGQGNPPGDLLLVVRLLPHPVFRLEGQDLYATLDVPAPIAVVGGKVRAMTLEGPVEVAVPPRTQAGRKLRLKGKGFPGPAGRGDLYLEVRITIPERLTPEEEALWKKLAEAYYARA

SEQ ID NO: 11286 - protein, 425 aa, Amanita muscaria
MSNKLALLVSVALSLLVIAAPLPESGVAVPIRKRACRLTDANGVFDHDKAVRATVLLKNKHRQNLINLRNNRGLDAFSKGARILPIARLPRLVNTRLQRRQSEPLTDQNGDTEWTGTISIGTPGTEFLIDFDTGSSDLWVPSAACSSSICEPKHKYDPTASSTSQLQNGTFTIQYGDKSTVSGPVYTDAVNVAGVQVTGQYLSPVTNLSSTFGTDPIDGLLGLAFPAISNMKQSPFFNTAIAQGSVSKPSFGFKLAKNDSELYLGGAKCKLYTGAIESHSLSSTTGYWQIGNASISVGGQTPVFQFETIIDFGTTVIYGPADGVQQLYGSVPGATLFDSSNGFYSFPCDSVPSVSFNWGGQDWPITSDNFNMGETTKGFGQWVGAIAAQNFGLGSKVWVFGDSFIKNVYSGFDFGSNSVGFATLA

SEQ ID NO: 11287 - protein, 315 aa, Corynebacterium glutamicum
MSDAPTVVAYLGPAGTFTEEALYKFADAGVFGDGEIEQLPAKSPQEAVDAVRHGTAQFAVVAIENFVDGPVTPTFDALDQGSNVQIIAEEELDIAFSISVRPGTSLADVKTLATHPVGYQQVKNWMATTIPDAMYLSASSNGAGAQMVAEGTADAAAAPSRAAELFGLERLVDDVADVRGARTRFVAVQAQAAVSEPTGHDRTSVIFSLPNVPGSLVRALNEFGIRGVDLTRIESRPTRKVFGTYRFHLDISGHIRDIPVAEALRALHLQAEELVFVGSWPSNRAEDSTPQTDQLAKLHKADEWVRAASEGRKLN

SEQ ID NO: 11288 - protein, 109 aa, Nicotiana tabacum
MGSKAFLFLGLFLAIFFLISFEVVAAELAETSNSMKSDNENGVYVDGRGGYNGAGSDGYYGGGRGRGGGGYKRRGCRYGCCRKGYNGCKRCCSYAGEAIDKVTEAQPHN

SEQ ID NO: 11289 - protein, 179 aa, Oryza sativa (indica cultivar-group)
MAGSGRDRDPLVVGRVVGDVLDAFVRSTNLKVTYGSKTVSNGCELKPSMVTHQPRVEVGGNDMRTFYTLVMVDPDAPSPSDPNLREYLHWLVTDIPGTTAASFGQEVMCYESPRPTMGIHRLVFVLFQQLGRQTVYAPGWRQNFNTKDFAELYNLGSPVAAVYFNCQREAGSGGRRVYN

SEQ ID NO: 11290 - protein, 437 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLP

SEQ ID NO: 11291 - protein, 271 aa, Myxococcus xanthus
MAREKDNIALSDEHNTRGIELADRGWLDEAIKEFKKAIDLDPSSAHAHDNLATVYAEKKLFREALSEYLTALKLEPESATAHYNLACFLSTHAGEMAVEEYKEAIELDPEYPDAHLNLGLTYADQGRVEEAMRELQTAIELDSQDAFPRHELAALMMDEGDYRSAITQLKEVVRLEPDNFEAQLDLGICFAQKGFYAEAERAYERARALNPEDLLLNYNLSALFALWGRPKDAVQYLQKSLTADRPKVMGWLSTDPMFDALKGDPDFEALF

SEQ ID NO: 11292 - protein, 378 aa, Microscilla sp. PRE1
MKIKTRIMSLKSKAAIATGDGAFIIDTTEVSSPQPDEVLVRIRAAGLCHTDHDSLRWGKSIVMGHEGAGVVEQVGNQVDALAPGDKVILNWATPCMQCYQCQEGNQHICENHSPVAAGANGHTPGHAHLEGTQWQGKPIERSFNIGTLSEYTLVKASACVKMDGDIPMSSASIISCGVMTGYGSVVNSARLTAGSSSVVLGTGGVGLNVIQGCRISGASKIIAIDINPQRLEMAKVFGATHTILADKNDLGLMQASEEVKKLTSGRGADYAFECTAISALGAAPLAMIRNAGTAVQVSGIEEEITIDMRLFEWDKLYINPLYGKCRPQLDFPKLESLYHKGELKLDEMITRTYQLEDLQQAFDDMLSGKNAKGVIVFD

SEQ ID NO: 11293 - protein, 417 aa, Microscilla sp. PRE1
MSQLDKTCVIIGASHAGVNCAFALRKEGWQGGIVLYDADPSLPYHRPPLSKAYLTSDAGIEKYLLKSAESYEKDNITLRLGIQVSAIDRTHKILTLNDGNTRSYDKLVIATGARPIIPPTKGIKTAKNLYPLRNAADVQNIRQALESNENKRVVIVGAGYIGLEIAASLKNRGAQVTVLEREDRVLARVTAPEMSAYFQQLHVSQGVEIVTNKNVVSIAPRNGFNTITCSDGTQYDADVIVMGVGIRVNLELAEDAGLNISNGICVNAAGQTNDEDIYAIGDCTLHYNPHYNRHIRLESVQNAVDQAKVTAAAICGKEVAYNAIPWFWSDQYDVKLQIVGLSSGYNELLIRREDDGRKFSSWYFKDDELLAVDAINNAKAYVIATKFIKERRKVDKIKLTDASVALSPLNLSAESHD

SEQ ID NO: 11294 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 11295 - protein, 198 aa, Hordeum vulgare
MENEFQDGKEQVIQAWYMDDSEEDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKIINRGGNQTVEAR

SEQ ID NO: 11296 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIPGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 11297 - protein, 1501 aa, Emericella nidulans
MSSQPSPPAPSGDVAPPGAVQQPSETVSRITDDNGAPSTAKEKAESSDITCASSEKDIDRDRKDIDQESELKITALARNLSRLSQKSGAVDGTNTFLDSSSDPELDPNSGQFNARKWTKNFLSVANRDPDRYPRRTAGVSFRNLSAFGYGTAADYQMDVANMWLKGFGWIRRKLGFVDRVRIDILRDFEGFVRSGEMLVVLGRPGSGCSTFLKTIAGETHGLWLDDGTDIQYQGISWDEMHSRFRGEVIYQAETEIHFPNLTAGETLLFAAQARTPANRFPGVTRDQYAHHMRDVTMAMLGLSHTMNTLIGNEFIRGVSGGERKRVSIAETILCGCPLQCWDNSTRGLDSSTALEFVRNLRLSTEYTGSTAIVAIYQASQAIYDVFDKAIVLYEGRQIYFGSASDARRFFVEMGFECPDRQTTGDFLTSLTSPTERLVRKGFENLVPRTPDEFAERWKQSAERKRLLEEIEAFQNEHPLGGSKYEEFTRSRAAEKAKGTRAASPYTLSYPMQIRLCLSRGFLRLKGDMSMTLATTIGNSIMALIISSIFYNMNGTTEKFFSRGALLFFAILLNAFSSALEILTLWQQRPIVEKHYKYALYHPSAEAISSMIVDLPAKVLVSIVFNIILYFMTNLRRTAGHFFVFYLFSFTTTLTMSNIFRWIGAISRSMAQAMVPSSIFMLILVIYTGFTIPVRNMHPWFRWLNYLNPIGYAFESLMVNEFSGRRFDCAMYVPDGPGYADVPLSSKICSGRGAVAGQDYIDGDTYLNTSFQYYRSHLWRNYGVLLAFMFFFLAAYIICSELVRAKPSKGEILVFPRGKIPAFAKEVRRDEEDAKTVEKPQLVGEKSDDHVGAISKQTAIFHWQDVCYDIKIKGENRRILDHIDGWVKPGTLTALMGVTGAGKTSLLDVLADRMTMGVITREMLVDGRLRDDSFQRKTGYVQQQDLHLETSTVREALIFSAMLRQPASIPRKEKLAYVEEVIKMLGMEEYAEAVVGILGEGLNVEQRKRLTIGVELAAKPDLLLFFDEPTSGLDSQTAWSICSLMRKLADHGQAILCTIHQPSAILMQQFDRLLFLAKGGKTIYFGELGENMGTLIEYFEKKGSTPCPKNANPAEWMLEVIGAAPGSHADRDWSEVWNQSPEREQVRAELARMKAELLQKPEPPRTPEYGEFAMPLWSQFLICLKRMFQQYWRSPSYIYSKATMCVIPPIFIGFTFWREPLSLQGMQNQMFAIFMLLVIFPNLVQQMMPYFVTQRALYEVRERPSKAYSWKAFMMASICVELPWNILMAVPAYFCWYYPIGLYRNAGPGETVERGGTMFLLILIFMMFTSTFSSMVIAGIEHPDTGSNIAQLLFSLCLIFNGVLATPQQMPRFWIFMYRVSPFTYLVSSVLSTGLSGAEVECSDIEILKIPPPDGQNCTSYLGPYAEGIHAKLLSDAPNGDCRLCSISSTNQFLASLSINPDDNWRNVGILFVYIVFNAFAAVFLYWLVRVPKKKSQQVKKQ

SEQ ID NO: 11298 - protein, 1515 aa, Emericella nidulans
MSSFLGTGTFNTSVSPSQAVESRGIENHGNAITETETLHNESHAESPGEKLASSSNSILSSTETAREKDERDYELDAEEEVTRLAQQLTHQSTKYSTHNIENPFLEVGEDSTLNPHSPNFKAKNWMKNLLALSSRDPERYLPRQAGVSFTNLSVHGYGSPTDYQKDVFNSVLQIGGLVRSMMGHGKQKIEILRNFDGLVKAGEMLVVLGRPGSGCSTFLKTIAGEMNGIFMDEKSQLNYQGIPAKQMRKQFRGEAIYTAETDVHFPQLSVGDTLKFAALARCPRNRLPGVSREQYAVHMRDVVMAMLGLSHTINTRVGNDFVRGVSGGERKRVSIAEATLSASPLQCWDNSTRGLDSANALEFCRTLNLMAKYSGATMAVAIYQASQSAYDVFDKVTVLYEGRQIYFGRTDDAKQFFIDMGFECPERQTTADFLTSLTSPAERIVRKGYEGRVPQTPDEFAAAWKNSDAYAQLMREIEEYNQEFPLGGESVNKFIESRRAMQSKNQRVKSPYTMSVMEQVHLCMIRGFQRLKGDASLTLSQLIGNFIMALVIGSVFYDLDNDTGSFYSRGALLFFAVLLNAFGSALEVCLILRLFLSLADSLQILTLYAQRPIVEKQARYAMYHPFAEAIASMLCDMPYKITNTFTFNIPLYFMTNLRREPGAFFIFLLFSFVTTLTMSMLFRTMAATSRTLSQALVPAAILILGLVIYTGFTIPTRNMLGWSRWMNYIDPIAYGFESLMVNEFHGRLFPCSESELVPSYGDTANRVCAVVGATPGELMVNGTTYLRESYQYTKSHEWRNLGIMFAFMAFFLFTYLTATEYISEAKSKGEVLLFRRGQAPPSVNDVETHSPATAGEKVDQSTQDVANIQRQTAIFHWKDVCYDIKIKNEPRRILDHVDGWVKPGTCTALMGVSGAGKTTLLDVLATRVTMGVVTGEMLVDGRPRDQSFQRKTGYVQQQDLHLHTTTVREALRFSALLRQPAKTPRQEKLDYVEEVIKLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGKTVYFGEIGEKSSTLASYFERNGAPKLPADANPAEWMLEVIGAAPGSHSDIDWPAVWRESPERQAVHQHLAELKETLSQKPTETSASDPSEYNEFAAPFSVQLWECLVRVFSQYWRSPVYIYSKAALSILTSLYIGFSFFQAQNTRQGLQNQMFSIFMLMTIFGNLVQQIMPNFVTQRALYEVRERPSKAYSWKAFMTANILVELPWNTLMAVIMYFCWYYPVGLYRNAEPTDSVHERGALMFLLILAFLLFTSTFAHMIIAGIETAETGGNIAQLLFSLCLIFCGVLAGPDVLPGFWIFMYRVSPFTYLVSAMLSTGVSGTTAYCEQVEYLTLYPPSNTTCSEYMDPYISQVGGYLQNPDATSECTFCQISSTDTFLSAVYSNYDDAWRNFGLMWAYIAFNIAAAVFIYWLARVPKGKKN

SEQ ID NO: 11299 - protein, 405 aa, Fragaria x ananassa
MRSASSIATMHFYMTPLLLLLALLVCVSASVENGKPVQSRFVEVVEEPKSSFNSSMADRSNDDWNEHAVDNPEEIASLVDTSIRNSSARRELGYFSCATGNPIDDCWRCDPQWQRHRKRLANCGIGFGRNAVGGRDGKYYVVSDPGHDDPVNPRPGTLRHAVIQDRPLWIVFKRDMVITLKQELIMNSFKTIDARGVNVHIAYGGCITIQFVTNVIIHGLHIHDCKPTGNAMVRSSPSHYGWRTMADGDGISIFGSSHIWVDHNSLSNCADGLIDAIMGSTAITISNNYFTHHNEVMLLGHSDSYTRDKQMQVTIAYNHFGEGLIQRMPRCRHGYFHVVNNDYTHWEMYAIGGSADPTINSQGNRYLAPNNRFAKEVTHRVQTTGRWRHWNWRSEGDLLLNGAYF

SEQ ID NO: 11300 - protein, 368 aa, Fragaria x ananassa
SIRNSTERRKLGYFSCGTGNPIDDCWRCDPNWQKNRKRLADCGIGFGRNAIGGRDGRFYVVTDPNDDDPVNPRPGTLRHAVIQDEPLWIVFKRDMVIQLKQELIMNSFKTIDGRGVNVHIANGACITIQFVTNVIVHGLHIHDCKPTGNAMVRSSPSHFGWRTMADGDAISIFGSSHIWVDHNSLSNCADGLVDAVMGSTAITISNNHLTHHNEVMLLGHSDSYTRDKQMQVTIAYNHFGEGLIQRMPRCRHGYFHVVNNDYTHWEMYAIGGSADPTINSQGNRYAAPTNPFAKEVTKRVETSQTQWRGWNWRSEGDLLLNGAFFTPSGAGASAVYARASSLGAKSSAMVGTITASAGALGCRRGRTC

SEQ ID NO: 11301 - protein, 309 aa, Helianthus annuus
MKAWKYDEYGSVDVLKLATDVAVPEIKDDQVLVKVVAAAVNPVDYKRRLGYFKAIDSPLPIIPGFDVLGVVLKVGSQVKDLKEGDEVYGDINDKGLEGPTQFGTLAEYTAVEERLLALKPKNLDFIQAAALPLAIETAYEGLERAKFSEGKTILVLNGAGGVGSFIIQLAKHVYGASKVAATSSTGKLELLKSLGADVAIDYTKENFEDLPDKYDVVYDAIGQPEKALKAVNETGVAVSITGPIPPPGFSFILTSDGSILTKLNPYLESGKIKSDNDPKSPFPFDKLNEAYAYLESTGPTGKVVIYPIP

SEQ ID NO: 11302 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWEE

SEQ ID NO: 11303 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGAKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 11304 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 11305 - protein, 264 aa, Bacillus halodurans
MIKVAVAGPRGKMGREAVKMIHEADTLELVAVVDSKHDGMLVRQLDGLPPSDAPVYNELERCLTSQTIDVLVDLTTPAHGKRHMEIALDHGVRPVVGTTGFTDEDITNLRKKAEEKGIGAIIAPNFAIGAILMMKFAQTAAKYLPDVEIIEMHHDRKLDAPSGTALKTAQLISEVRKAKQQGHPDETEELKGARGADFEGMSIHSVRLPGLVAHQEVLFGGVGQTLKIRHDSMNRESFMPGVKLSIETVMGIDTLVYGLENIIE

SEQ ID NO: 11306 - protein, 437 aa, uncultured crenarchaeote 4B7
MTNTQEIYKKKTKNSAKLFTKSKKVHINGVHHNIRFFEPYPFITKSADGKFLKDVDSNKYVDYWMGHWSLILGHAQKQIQKKASGQLKKGWMHGTSNENAISLSEKISKAVPVAEKIRYASTGTEATMYSVRLARAVTGKKIIAKIDGGWHGYTTDLLKTVNWPFDVSESQGLTDEEHIISLPLNNLQESLKILNSIKNDLAGVLVEPILGGGGAIPATQEYLKGIQEMVKTNNALFMLDEIVTGFRFRYGCIYSKMKLDPDIVTLGKIIGGGFPIGVICGKDEIMEHANTSLNSKKNRTYIGGGTFSANPLTMIAGDTTLDVLKNKTNTLYKKLNGLGDNTSKMLKKIFSDDVIVTGKGSLFMTHFPRDEMTEINNAADAAKCDSTKLFNYHFEMITKNGIFFLPGKLGAFSDAHSTVDVKDMKKATEDFVSNFKK

SEQ ID NO: 11307 - protein, 257 aa, Vibrio cholerae
MRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 11308 - protein, 218 aa, Olea europaea
SGQLEWQDYFFHCIYPEEKRDIWPKTPTDYSPATSEYAKQLRGLTSKILSALSLGLGLEQERLEKEVGGMEELLLQFKINYYPKCPQPELALGVEAHTDVSALTFILHNMVPGLQLFCEGKWVTAKCVPNSIIMHIGDTIEILSNGKYKSALHRGLVNKEKVRISWAVFCEPPKEKIVLKPLPETVSEAEPPRFPPRTFSQHIMHKLFRKSEDSGEEK

SEQ ID NO: 11309 - protein, 162 aa, Olea europaea
GDASGTMGGACGYGNLYSQGYGTNTAALSTALFNNGLTCGACYELTCNSDPKWCLSGTIKVTATNFCPPNPSLPNDNGGWCNPPQQHFDLAQPAFLQIAQYRAGIVPISFRRVPCVKKGGIRFTINGHSYFNLVLITNVGGAGDVHSVSIKGSRAGWQQMSR

SEQ ID NO: 11310 - protein, 158 aa, Streptococcus intermedius
MTKIYDFSIFDQNNRSISLEIYKGNVLLIVNTATGCGLTPQYKGLQHLYTRYQNQGFEILDFPCNQFMGQAPGTAEEINRFCSLHYQTTFPRFAKVKVNGKEADPLYIWLKEQQAGPLGKRIEWNFTKFLINREGQVVKRFSSKAEPKEIEESLQKLL

SEQ ID NO: 11311 - protein, 323 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTWTGVTPYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 11312 - protein, 496 aa, Streptomyces coelicolor A3(2)
MADPKGFLTTPREEWPRRPAGERVRDWDEVYVPGALLPIVGRQADRCMDCGVPFCHEACPLGNLIPEWNDLVSRSDWRAASERLHATNNFPEFTGRLCPAPCEAGCVLAINQPAVTIKNVECAIADTAWEEGFVPPLPPERLSGRTVAVIGSGPAGLAAAQQLTRAGHTVAVYERDDRIGGLLRYGIPAFKMEKRHLERRVGQMRAEGTRFRTSAAVGRDVDAAALRTRYDAVVIATGATAWRELTVPGRELAGVHQAMEYLPLANRVCEGDLERSPLSAAGRHVVVVGGGDTGADCLGTAVREGAASVTQLDIYARPGAERDERAEPWPTYPRLYRLSAAHEEARDLRSAPAADADARLFAASTLRFTGDERGHVRALHLVGVDTGRRPLPGSERSLPADLVLLALGFSGPDRHDGLVDGLGLDMEPRGTITRDRGFATNVPGVFAAGDAARGQSLVVWAIAEGRAVAAAVDRHLSGGSTRLPAPVGPYDRPMTA

SEQ ID NO: 11313 - protein, 315 aa, Solanum tuberosum
MENFPIINLEKLNGDERANTMEMIKDACENWGFFELVNHGIPHEVMDTVDKMTKGHYKKCMEQRFKELVASKGLEAVQAEVTDLDWESTFFLRHLPTSNISQVPDLDGEYREVMRDFAKRLEKLAEELLDLLCENLGLEKGYLKNAFFGSKGPNFGTKVSNYPPCPKPDLIKGLRAHTDAGGIILLFQDDKVSGLQLLKDEQWIDVPPMRHSIVVNLGDQLEVITNGKYKSVMHRVIAQTDGTRMSLASFYNPGSDAVIYPAKTLVEKEAEESTQVYPKFVFDDYMKLYAGLKFQAKEPRFEAMKAMESDPIASA

SEQ ID NO: 11314 - protein, 319 aa, Solanum tuberosum
METFPVVNMEMLNTEKRAAILEKIKDACENWGFFEVIYHGISHDLMDTVEKFTKEHYKKCMEQRFKEMVASKGLEAVQTEIDDLDWESTFFLKHLPVSNISEVPDLEDDYRKIMKEFADKLEKLAEQLLDLLCENLGLEQGYLKKVFYGSKGPTFGTKVSNYPPCPKPDLIKGLRAHTDAGGIILLFQDDKVSGLQLLKDGKWIDVPPMRHSIVINLGDQLEVITNGKYKSVEHRVIAQPDGNRMSLASFYNPGSDAVIYPAPELLEKEEKENTVMYPKFVFEDYMKLYAGLKFQAKEPRFEAMKAVETAVNLGPIATV

SEQ ID NO: 11315 - protein, 189 aa, Nostoc punctiforme
MLQGITPKLRSPIVLFTYYNPILHRGIDKFLQEIAAAGVAGLVVPDLPLEEAAGLLEPAKEMGIDVILLVAPTSDAKRIEAIAHSSQGFIYLVSVTGVTGVRSQLESRVSDLLKQIRGVTEKPIGVGFGISDAAQARQVKEWGADAAIVGSAVVKRLAEGTPEQGLSAIAQLCQSLKAAIKTSTNTPLD

SEQ ID NO: 11316 - protein, 295 aa, Helianthus annuus
NLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHE

SEQ ID NO: 11317 - protein, 271 aa, Helianthus annuus
NWGFFEIVNHGISTELLDTVEKMTKGHYKKCMEDRFKDMVASKGLEAVQNQIDDLDWESTFYIRHLPESNISEIPDLEDEYRKVMREFAKELEKLAENILDIFCENLGLEKGYLKKAFYGAKGPTFGTKVSNYPPCPKPDLIEGLRAHTDAGGVILLFQDDKVSGLQLLKDDKWIDVPPMHHSIVINLGDQLEVITNGRYKSVMHRVIAQPDGTRMSIASFYNPGSDAVIYPAPQLVNKEEEKSNIYPKFVFEDYMKLYTAVKFQAKEPRF

SEQ ID NO: 11318 - protein, 149 aa, Piromyces sp. E2
PGAGKGTQAPKVKDTYCICHLATGDMLRAAVKAGTPIGLEAKKIMDAGGLVSDEIVVNLIKENLDTKACRNGFILDGFPRTVAQAEKLDEMLEQRNQKLDTAIELTVDDSLLFKRITGRLVHPASGRSYHKIFNSPKVEGKDDITGEPL

SEQ ID NO: 11319 - protein, 149 aa, Neocallimastix frontalis
PGAGKGTQAPKVKDTYCICHLATGDMLRAAVKAGTPIGMEAKKIMDAGGVVSDEIVVNLIKENLDTKACRNGFILDGFPRTVAQAQKLDEMLEQRNQKLDTAIELTVDDSLLFKRITGRLVHPASGRSYHKIFNPPKVEGKDDITGEPL

SEQ ID NO: 11320 - protein, 151 aa, Neocallimastix frontalis
  misc_feature (136)..(136): Xaa can be any naturally occurring amino acid
PGAGKGTQAPKVKDTYCICHLATGDMLRAAVKAGTPIGMEAKKIMDAGGLVSDEIVVNLIKENLDTKACKNGFILDGFPRTVAQAQKLDEMLEQRNQKLDTAIELTVDDSLLFKRITGRLVHPASGRSYHKIFNPXQKVEGKDDITGEPLI

SEQ ID NO: 11321 - protein, 230 aa, Petroselinum crispum
MISSWRKIRASRHANKRNGLDDLSNMEVSIPNHFRCPISLDLMKDPVTLSTGITYDRHSIETWIEAGNKTCPITKQMLSTLEPIPNHTIRKMIQDWCVDNSSYGIERIPTPRIPVSSHQVTEMLSKVVAACRREEASACRELVGKIKRLVKENERNKRCFVANGTVGVLASTFEAFSKLSFDKNVAVLEEILSCLSLMTPLDGEAKAFLGSNSSLNCMVWFLKSGDLSAR

SEQ ID NO: 11322 - protein, 442 aa, Petroselinum crispum
MISSWKKIRASRHANKRNGLDDLSNMEVSIPNHFRCPISLDLMKDPVTLSTGITYDRHSIETWIEAGNKTCPITKQMLSTLEPIPNHTIRKMIQDWCVDNSSYGIERIPTPRIPVSSHQVTEMLSKVVAACRREEASACQELVGKIKRLVKENERNKRCFVANGTVGVLASTFEAFSKLSFDKNVAVLEEILSCLSLMTPLDGEAKAFLGSNSSLNCMVWFLKSGDLSARANSVLVLKHVLSTDQKKMEEFSMIEGSLEALVKVIKEPVSPTTTKASLLIVYYMVSTSSSSRVDDKIIARFIDMGLIERLLEMLVDCDKSICEKALGVLDGLCLTNEGREKAYANALTMPVLVKKILRVSDLATEFSVSIVWKLSKNDKSEDGGVIVEALRVGAFQKLLLLLQFGCNEKIKDKATELLKLLNLHRDKLECIDSMDFKNLKRT

SEQ ID NO: 11323 - protein, 379 aa, Lactococcus lactis subsp. cremoris
MNNTEYYERLGVDKNASQDEIKKAYRKMSKKYHPDLNKEEGAEDKYKEVQEAYETLSDEQKRAAYDQYGEAGRNGGFGGGGFGGASGFSGFGGRSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQTTCDVCHGTGKEIKEKSTTCHGSGHEKVAHTVKVTVPAGVETGQKMRLQGQGDAGVNGGPYGDLYVVFQVEASDKFERDGAEIYYKMPMDFVQAALGDEVEVPTVHGNVKLKIPAGTQTGANFRLKGKGAPKLRGSGNGDQYVIINIVTPKNMNQAQKEALQAFAKASGIEVSGSGQKGFFDKFK

SEQ ID NO: 11324 - protein, 440 aa, Cochliobolus lunatus
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 11325 - protein, 220 aa, Arabidopsis thaliana
MGRSLINSCFPIIRRRQGIVTLVFFEHVSTKTLCGFKKHVAGEIMFEFPDQIVCHADSFYIGRQIPALAMDDYLIPGQTYFVLPIERFQYKILTTSCLSIFNSNLENVRSNTPPLNFTAPSSPPPFEYSQGPNGKILIKVSPEFIISLICKNRNIREEEATSCGENSAICNSPELKKQYDQLVGTREHMWSPNLQTISEHKIRVSPLRFFGLNRKQDEVN

SEQ ID NO: 11326 - protein, 272 aa, Thermus aquaticus
MSPFLGELIGTALLIIFGAGVCAGVNLKKSYAANSGWIVITMGWGLAVAVAVYAVGQYSGAHLNPALTVALALAGDFPWKDVPGYIAAQVLGAVMGAVIVYLHYWPHWKETDDPGVKLGVFATGPAVPNAAANLLSEIIGTFVVGVAILAIGANQFADGLNPFVVGFLIVAIGLSLGGTTGYAINPARDFGPRLAHFLLPIPGKGSSNWAYAWVPIVGPLLGGALGSLVYKAVFLGKPTGALWGVLAATAVVLAAAKMAKGKTANAASRRSL

SEQ ID NO: 11327 - protein, 369 aa, Galactomyces geotrichum
MLFSKSILLSMAAALAVAAPTETEVNLYARDSCVFTSADKAIADKKSCSTITLKNIAVPAGKTLDLSNLNKGTTVIFDGTTTFGYKEWTGPLIKVSGDTITVKQTSGAKIDCAGSRWWDSKGGNGGKKKPKFFAAHGLKNSKIEGLKVYNTPVQAFSISGSEQLALNNILLDNKAGDSQGGHNTDAFDVGGSSDITIDGAIVYNQDDCIAVNSGNRIKFLNGYCSGGHGLSIGSVGGRSNNIVDDVLIKNSQVVNSDNGVRIKTVYGATGKVNNVRFEDITLDKIVKKGLIVQQDYENGSPTGNPTNGVSVTNITFKNVKGNVLAKGINYYLLCGKGSCSNWTWSNVKIIGGKTSDGCKNYPSNATCKN

SEQ ID NO: 11328 - protein, 1037 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 11329 - protein, 220 aa, Helianthus ciliaris
QYGRETRHTGDYENPIHSTGGQYDQDVRQTDEYGNPVRITDEYGNPVHSATGGTMGDYGSTGLGQGTGGLGTGVGHTTGGTGTDYTSGGRSTGQTGYQGLGTESEFGGTTGTFQNQPSATPIGGTGLSSGTGAGFGGIGTGTGTGILHRSGSGSSSSSEDDGQGGRRKKKGVMQKIKEKLPGGHSQEEQYQSQTTTTGYGETHEKKGMMEKIKEKLPGHH

SEQ ID NO: 11330 - protein, 202 aa, Beta vulgaris
MSNSGEVEAQIPATNNFPATEVKVPEEKPEVDTKGRKREKKQKSSMEKKHKAPSHPPYFQMIKEAILALNEKGGSSPYAIAKFMEQKHKTVLPSNFRKILGLQLKNSVSRGKLIKVKASYKLSEAGKKRSEKGSKSRSSSSSTTKAARANAAKEPTKRRRPKSKSVSKIDNPPVNPAITARRSKRSKPKQKLLKTIKKKANA

SEQ ID NO: 11331 - protein, 282 aa, Beta vulgaris
MCESFKRQYQLCDEIGRGRFGVVFRCFSPSSHTSFAVKSIDKRLLLDDETDRECLDKEPKILQILSPHPNILQIHDIFDSDSHLLIVTDLCQESTLYDRVVSAGPFSETDACSVFTQLIDALAHCHRNYICHRDVKPDNILFDSRNRVKLCDFGSAEWFGGVEGRERMNGIVGTPYYVAPEVLAGREYNEKIDVWSAGVILYIMLGGVPPFYGDTVEDTFAAVLRGNLRFPTKIFRSISPEAKDLMRKMLSKDVSRRFSAEQVLRHPWVTSGGMTSTMNDMS

SEQ ID NO: 11332 - protein, 512 aa, Chlamydomonas reinhardtii
MQSIAHRIISGLGSAVDSSGAWRCARQSLHVGSTASCAEFQLNTVRAESFYDSTVEKYAAQDVEVLSLRQMLSFGRNAWNDPDKVLKSARYVQRELPKRLARRLLDLQLLPYIVVTNPHIKKVYNQYYISFETLRRVPTIRTLEENQDFCQLLRQHLDSHAPMLDSLATGLRECKSKELVGSCLRMDSFFDSMLRSRISRRVIAEQHLHINNKRPAFIGIICTDLDVHDSIDFAVQKTKQVCMETYGTAPDVVVSGDPHVTIPYIPAHLDYMLYELLKNAMRAVVEQGRAQQPARQAQAGGAGNPAFSCPPPKLPPVHVRVCPGLNGTLTIRITDQGGGIAEEFIDKVWSYGFTTIGRSAAASTHSSSSSSSSSSTSGSGGKDGVGPDVVEGLGSGMVQQVAAGAGGSGSAAAASSGGGGSSTGGRRQQQPGSGLQVLMRGPGGHSRYQMAGLGFGLPLSRLYARYFGGDLRLQTIPGYGVDAYLTLRRLEEHEWEEHVDEPSTLPINMAPY

SEQ ID NO: 11333 - protein, 242 aa, Mangifera indica
RLQLQKKGVGGDGLVLPKYKGLLGTVGTIAREEGLAALWKGIVPGLHRQCLFGGLRIGLYEPVKTFYVGSDFVGDVPLSKKILAAFTTGAIGITIANPTDLVKVRLQAEGKLPPGVPRRYSGALNAYSTIVRQEGLGALWTGLGPNVARNAIINAAELASYDQVKQTILKIPGFTDNVVTHLLSGLGAGFFAVCIGSPVDVVKSRMMGDSAYKSTLDCFIKTLKNDGPLAFYKGFIPNFGRL

SEQ ID NO: 11334 - protein, 465 aa, Acridocarpus natalitius
VGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNPPGAVANRVALEACVQARNEGRDLAREGNEIIREASKWSPELAAACEVWKEIKFEFPAMDTL

SEQ ID NO: 11335 - protein, 468 aa, Aspicarpa pulchella
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVCARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11336 - protein, 468 aa, Aspidopterys elliptica
KASVGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11337 - protein, 468 aa, Burdachia sphaerocarpa
KAGVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11338 - protein, 463 aa, Caucanthus auriculatus
VGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHSGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMD

SEQ ID NO: 11339 - protein, 468 aa, Dinemagonum gayanum
KASVGFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREAGKWSPELAAACEVWKEIKFEFPAMDTL

SEQ ID NO: 11340 - protein, 468 aa, Dinemandra ericoides
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCTEAIFKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREAGKWSPELAAACEVWKEIKFEFPAMDTL

SEQ ID NO: 11341 - protein, 468 aa, Flabellariopsis acuminata
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11342 - protein, 466 aa, Hiptage benghalensis
VGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVSLEACVQARNEGRDLAREGNEIIREASKWSPELAAACEVWKEIKFEFPAMDTLY

SEQ ID NO: 11343 - protein, 468 aa, Hiptage sp. KMC-2001
KASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQADTGEINGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11344 - protein, 468 aa, Hiraea smilacina
KASVGFKAGVKDYKLTYYTPDYETKDTDILAAFRVTPQPGVPPEEAGAAVAAESSTGTWTTVWTDGLTSLDRYKGRCYDIEPVAGEDNQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASQWSPELAAACEVWKEIKFEFPAMDTL

SEQ ID NO: 11345 - protein, 468 aa, Jubelina rosea
KACVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11346 - protein, 465 aa, Lophanthera lactescens
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11347 - protein, 466 aa, Lophopterys floribunda
SVGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGLVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11348 - protein, 465 aa, Malpighia emarginata
VGFKAGVKDYKLTYYTPDYQTKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11349 - protein, 468 aa, Mascagnia bracteosa
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMLTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFVEEDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11350 - protein, 468 aa, Mascagnia chasei
KASVGFKAGVKDYKLTYYTPDYETKDTDILAAFRVSPQPGVPPEEAGAAVAAESSTGTWTTVWTDGLTSLDRYKGRCYHIEPVAGEDNQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQAENREIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11351 - protein, 468 aa, Mascagnia dipholiphylla
KASVGFNAGVKDYKLTYYTPDYQTKDTDILAAFRVTPQPGVPPEEAGAAVAAESSTGTWTTVWTDGLTSLDRYKGRCYDIEPVAGEDNQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11352 - protein, 468 aa, Mascagnia hippocrateoides
KASVGFKAGVKDYKLTYYTPDYETKDTDILAAFRVTPQPGVPPEEAGAAVAAESSTGTWTTVWTDGLTSLDRYKGRCYHIEPVAGEDNQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11353 - protein, 465 aa, Mascagnia sepium
VGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVAVEACVQARNEGRDLAREGNEIIREASKWSPELAAACEVWKEIKFEFPAMDTL

SEQ ID NO: 11354 - protein, 465 aa, Mascagnia stannea
VGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNPPGAVANRVALEACVQARNEGRDLAREGNEIIREASKWSPELAAACEVWKEIKFEFPAMDTL

SEQ ID NO: 11355 - protein, 465 aa, Mezia araujei
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11356 - protein, 467 aa, Peixotoa glabra
ARVGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGLVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11357 - protein, 465 aa, Pterandra arborea
VGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGLVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11358 - protein, 468 aa, Verrucularia glaucophylla
KASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHGGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 11359 - protein, 137 aa, Triticum baeoticum
FGLFLARKVSLIRALLYIIAQCLGAICGVGLVKGFRSSYYVRYGGGADELSAGYSKGTGLAAEIIGTFVLVYTVFSATDPKRNARDSHIPVLAPLPIGFAVFMVHLATIPITGTGINPARSLGAAVIYNKDRAWNDQ

SEQ ID NO: 11360 - protein, 410 aa, Aeropyrum pernix K1
MGGRLATLDDVDVRGKKVIVRFDLNSPVGNGGEILDDSRIAEAAGTLRELCDRGAAVVALSHQGRPLESDFVSLERHASLLSRYSGVEVRFVMDVIGPEALRTVASLRPGEAVLLDNTRIISEDFIEAEGTVHARGIMVTRLSKLANMYVNEAFSASHRSQASIVGFPYVLPSAGGRVLEKEIRSLNRAVSSGERPKVVVLGGAKLKDAVRIVDYLSSSGVADEVLTTGLVGLLFLYARGYRLPRDVTKLLEKKGGEEAIAKARRIVEEGRRVRTPIDFVVEVGDKIYIKPADELTEGVPKDIGPSTVEYFRAKMRGARVIVMRGPAGVIEDPRFRRGTVELVKAALSSGAYTVFGGGHFRAILRDLPEHLSSKVGHLSTGGGALLYYLSGRPLPGVKALVDSARIFNLV

SEQ ID NO: 11361 - protein, 215 aa, Aeropyrum pernix K1
MTARSYREVVSAVEEKVASLRGGRLFIFLGGDHSITYATLRALRSFYRGRLGLVYLDAHPDLYDEYEGDRYSHACTLRRIVEEGFVDPRDVILAGVRAATPSQLDFAEKAGITVLGVEEAEDLAAYLKEGMPYYISYDLDVLDPAYAPGVGNPEPGGLSTREMVRIIKSLPEDVLAFDVVEASPPHDPSGLTLFTAAKIIRETLARARPPGWGEV

SEQ ID NO: 11362 - protein, 452 aa, Aeropyrum pernix K1
MAVDAPRIVVEPPGPRAREVLERDERVIMQSFTRWYPLVVKRGYGAVVEDVDGNRYIDFNAGIAVLNVGHNHPRVVEAVKRQLERFLHYSLTDFYYEEAVSAAERLARSVPISGGAKTFFTNSGAESIEASIKVVRAFFRGTRPYIISFLGGFHGRTYGAMSASASKPVHRARFYPLVPGFIHAPYPDPYRCPFPGLEGEACGEAAVSYIEDYIFSKLVDPGEVAAFLFEPIQGEGGYVVPPDSFLPSLQKLARKHGILLIADEVQTGFARTGRMFAVEHWGVEPDVMALAKAMGGGLPLGAAVGRSEVMSLPRGSHANTFGGNPVALAAFNAVMDVIEGERLWERSQRLGEKALKILGEAAEELSIVGHVRGKGLMIGVELVRDENTREPHKEALAWVLDRSFKRGLLVIGAGVSAVRIAPPLTIEEELFDRGLEILVEVLREADRRFSQV

SEQ ID NO: 11363 - protein, 458 aa, Aeropyrum pernix K1
MRGPVKIVATVGPSSSSASILAQMLSLGVDVARINASHGGVEQWNSMLESLRRAEEAVGKRVGVAVDLEGPRVRTGNSEPVKLEKGDLVTLGFMEGDVPVDARQFFETIDEGDIVLLDDGKIILQVESVEGFRVKARVLEGGVLGPRKGVVVRGKEPDLPPLSAKDRRALEFFADKGVSHVYVSFARSAEHVEKVRTVVRRLGLRQARIFAKIEGPSGVSRIGEIAEASDGVIIARGDLGMHYSLEELPEIQELIVWEARKRYKTVVLATEFLSSMIEKPVPTRSEVVDIYQAVLQTADALMLTGETAIGKYPVKSVQWMAKISSRAYKKLATSPPERPRPTSTPYKLALGLVELAESLDSPLVVYSKTGRFAERLASFKPLKTFYVGVPSREVERVVRHLWGAEPIVVGDYPYEAGLAKTYEKLRRENIIHGDETVVEAAWSSERGIYIIRVRNLEF

SEQ ID NO: 11364 - protein, 337 aa, Aeropyrum pernix K1
MKFLRCKEIPPSTGKTVSIIGAGPAGLGAAGFLRCRGHEVVVYDMMPEPGGMMMFGIPDDRIPKDNIRKSVRELVEGGARIILNNKVGRDISLEDIIKASDAVLIATGTWKPRRLGAPGEDLPWVLPAADWLVEVHMARYGYLPWAKVPKVGGRILVVGGGLTAADAVHVPLTYPEFKDGVEKVVLSYRRTRDYAPMRKNEFERLIKMGAEAWELTQPIAFYEEGGRKVVKFVRMELKASDSGRPKPVPIEGSEFEAEFDWALLAIGEVPTPPFNNGCCGIELNPDGTIKTDENFMTTRKGVFASGDVRHGPSLIGKALKSGLDAAQKVHLYLTGQL

SEQ ID NO: 11365 - protein, 381 aa, Aeropyrum pernix K1
MASLGEILEGRATDIYFVRTRRVAEKYGVGGKRVRMEVHAYSLPRGYEWAVYAGLEEALALLQGKPVTVYSLPEGTVFERKDPLMVVEGRFQDIILFETALLGLLRFSTSIATKAARVRLAAGRGKTVLFFGLRALHPAVQPAADRAALVGGLDGVSGVLSREYLGVEPRGTMPHALIIVFGSQVEAWRAFAETFKEETPVIALVDTFWDEREEALMAARELGEVLAGVRLDTPSSRRGRMRDIVEEVRWALDIHGYKHVKIFVSGGLDEERVAELRDVADGFGVGTTIAAAPNIDISMDVVEVHEDGEWRPRTKRGKLPGARSIVLCRGEKRIVRLGEEPEGCEPLTRKYLEEGRLAQSLPSLDEIRSYVLKQLENLGLQ

SEQ ID NO: 11366 - protein, 373 aa, Aeropyrum pernix K1
MGRCSHGLREGRRGEPVRDPTPLDRAGCSVLPGGAKLYYSMAFKMHVPPRGSGHIEEPRRLDKALKALKKSRLLDMLEKVDPGFQSLRVFETVHDPLYIKGILAELEAALDSYFIDSDTYISPGTQAALEALAASVEQASEHVAEGGKALVLGRPPGHHAGVAGPGLGAPSLGACLVNAAASLAYRLAGRGLKVLILDFDANHGNGTQEILQALPMGDRLFHLDMHQDWRKSFPWTGEPGVTGDGTALNIVLPEGSGDDIVLALIEGLEPLVNESEPDAVVVSMGFDGYSGDSPLTLTKLTSHTFHALGRLASRYPVAAVLETGFGRGLELGLPAFIAGLLGLGNPVQEEAIKSDEEVWREFLETNKEVVEHG

SEQ ID NO: 11367 - protein, 461 aa, Aeropyrum pernix K1
MLRSEYDIIVIGGGAAGFSAVVAAAEGGASVLLVSEGPLGGTCVNFGCVPSKHVLYNLSTARKAGLKISLSEALEGARKVSETLRKEKYESLLDSLGVDYLRGRARFKAPGIVEADGREVRYRKAAIIAVGARTWRPPIPGLKEAEKAGRILDNERLFGEGPPPDMESVAVIGGRAQGVEAAQIFARSGLKTVLLQRSGRLLPRDEPEAGVYMKRVLEGDGVEVRTSARPLRVESVRGAVRIDYETPQGPASVEASYIYLATGRKPVLDGLGLENVGVRVSSDGFIVVNEKLMASPGVYAAGDCIGGIQLEPVAAREGYVAALNALGGNVEMDYTVIPRAVFTDPEFASVGLTERELARKLGVCACRTVDITQIPRARIMGYETGFVKMVVDPRTKKVAGVHMMAPQAAEAIHEAAFILKAGMTVDDVIDTIHIFPSISEGIKYAALAFYRDVSKMPCCLL

SEQ ID NO: 11368 - protein, 388 aa, Aeropyrum pernix K1
MNVVLKFVRFYGYRGLRIVKGSMQYVWDDSGRKYLDCHAGHGAAFLGHSNPAIVEAVVRQARELVAASSSFSTPSLEEALTEFSRIAPPWAEEIVFLNTGTEAVEAALKAAWLATGKRGIVALKNSFHGRTLASLSVTWNPRYRRGVPVLDTRFLSPSTDPGEVEKLVPEDTAAIIVEPIQGEGGLTKIYAELAKALREAADRVGALLIFDEIQTGFGRTGRVWAHESLGVEPDIMTAGKSIAGGLPASAVLSREGVLATLASGRHGSTHAANPLSMAAVAAASRFLREEGVPDKARAAGALLEGLLRDRIEGLRLVRGVRGEGLMLGVELRLDPGPVLRCLQESERVLALRSGATVVRLLPPYSISREDAEMVVYGLERCICGGSGC

SEQ ID NO: 11369 - protein, 444 aa, Aeropyrum pernix K1
MPGVPYRVDSVLAGNSGHTIDTLLLTFDDVAILPGLSTVEPHDVELSSRVSRSIFVSTPLVSSPMDTVTEWRMAAALARLGAVGVIHRNMPREEQARHVSMVKSVSPSPWSEVPRIRLPDGLENYSLILEELDAGAAVVFGDDGIKGYLVLERPDAQLWLEKARYLSLYLTRIRPFPTIDGEGRLVVGAAVSPFDLDRARLLEKSGADFLVIDVAHLHNRNALSSLSRLVKEVSIDVVAGNLGTREGVLDTLARAEEVAGLRMGISSGSICSTGEVAGAAVPTLTAVMNAVLALEELGLAGRIPIIADGGVRNAGDAAKAIIAGASAVMGGRLFAGADESPGPRIRVGDKLYKPYRGMASRGAMERRFAVDRYSRQAKAVEEGVEGLVPYTGPVVKTLYELAEGLKAALGYAGAQDVTSAWKAKLARVTPTGSREIRPHDILLG

SEQ ID NO: 11370 - protein, 338 aa, Aeropyrum pernix K1
MGAIIVDGASRITALNPLTIYLSGGRVETGSRARDLYLLRPPEPVFGIQRSREESLFSVIGVPYDSTSSFRPGQRFAPREIRRASIELESNGYYVEGDIDRVPIADEGDVAAVPGSTLLTLERVARVVEDLAREGKVPVVLGGEHLVTLGALRGLAAAGVKPCVVVLDAHFDLRNDYLGERFSHATVFRRVLEELGVKLLYIGVRAYEAGEERLAVESGLIDYVPMRRMDIVGVDGAVLAARRFTGDCEKIYISIDMDFYDPAYAPGVGNPEPGGASSREGLALASQLGDRRVCGIDVVEVSPPYDPGGATSLLAAKTLQELLISVWQRWGVGRSASS

SEQ ID NO: 11371 - protein, 335 aa, Aeropyrum pernix K1
MAGEPRLGRTGPRVSRVGLGLWQFGSPMWGGKALSADVLARGLSIAVEEGINLLDTAEVYGMGSSERMLGEALKRLNAREDFVIVSKVAGFRSTAGDIVKGARGIAGRLSSAPDVILHHWPPPVYSRLCSVVRGLEQAVNEGLASYYGFSNYGEDLLGDALSCTRRLEPVADQILYNLAYRTPEQRLIPLLHQHGMTPIAWSPLAKGALAGFKGEPTRAQAGDPVFRTALEDTGLQEVLESVARRLGASKASVALAWVAYKGAVPIVGWRRPERVREAAAAARLKLSEEDVALLDEASKRYVTLWGSSYSPPGLRRIRLIPGALQRLAIRLWGGI

SEQ ID NO: 11372 - protein, 467 aa, Aeropyrum pernix K1
MAGLERFDLVVVGGGPGGYPAAVRAAQEGLNVALVEMDSLGGECTNYGCIPTKALLHPAGLVASLARLKFVKGSVDVDFKGLMEWVDSVVKGVSNGVSTLLKGYGVEVVKGRAKIRPGVVEVDGSGSIGYSKLVLALGTSPASIPGLEPDGEVVHNNRTILGLRRKPGRMLIVGGGYIGVEYATAMARLGVEVTIVELLDRLLPNMQRDFSRVVERRLRAEGVKIHTKSKVEAVERRERYAVVEVSGVGKMEYDAILVAVGRRPNTGDVGLEKLGVKLDKAGYIQVDGATLETGVPGVYASGDVTGPPLLAHRAFLQAVVAAERAAGDSSAAFDAKAVPAVVYTDPELATVGLTLEEARAAGVDAAETRLPLASLPRVGAIEGCRECFAKVVYDRSSRAILGFHVAAPHASEIIAEAALAIEMGATLEDLALTIHPHPSVSEALKEVAELALERPIHYILRRGGARR

SEQ ID NO: 11373 - protein, 347 aa, Aeropyrum pernix K1
MGCVYSLWCGSAMKRPRVFVTREVFPEALELLSKYYDVEVWDKYQPPPYETLLSKAREADALYTLLTDRIDCDLLSQAPRLRIVAQMAVGFDNIDVECATRLGIYVTNTPGVLTEATAEFTWALILAAARRVVEADHFVRWGEWWRLRTGWHPMMMLGVELRGKTLGILGMGRIGSRVAEIGKAFGMRIIYHSRSRKREIEKELGAEYRSLEDLLRESDILSIHLPLTDETRHLIGESELKLMKKTAILVNTGRGAIVDTGALVKALREGWIAAAALDVFEEEPLNPNHPLTAFKNVVLAPHAASATRETRLRMAMMAAENLVAFAQGKVPPNLVNREVVKVRQPGF

SEQ ID NO: 11374 - protein, 272 aa, Aeropyrum pernix K1
MPLFPIDYNDFKPIGKTKERLSAVGLGTWAIRDYSSALESYVYAIERGINHIDTAEMYGAGEAERFVGKVLRSVGRDRVYVVTKLYPFRFRDPDEAVKAARASAERMGVSYVDIILIHWPDPQTPIKDQVKSLEAIAEAGLARYIGVSNFSKEQLEEALTATKKHEIVVNQVKYSVLDRRAEELIPLAVEKSILLEAYSPLERGHVAEVRLLAKIGRQYGKTPVQVALNFIVSRPNFIAIPKAERREHVDEILGSLGWRLKPEDIELIEEKL

SEQ ID NO: 11375 - protein, 394 aa, Aeropyrum pernix K1
MSWAKGSRIRDYRGREYIDFHMAFGAVALGHNDDDVAARVSEQLNRLVLHGAGVSDAEIEFAKMLIRKFPMYDKVLFTNSGSEAVMMAMRLARAYTGRDVVVKFDGNYHGWHDYSIYNIKNPASKGKTVESKGVPSATASTVEVLPYNDVDALEDYAERFGDRVAAYILEPVAHSMGVIPAEKGFVERLRKLCDTHGSLLIFDEIITFIRASDRGMQDYFGVRADLTTVGKAIANGMPVAAVLGGDNVMELLARGVVSSGTYSGHPLSMAAGVATLEKAEDVGLTRALRSRAEALAGILRDISEDLGVEAAVSQFGGSVSIYFGIDRRPKNLEEALRANGDAYRVFAREMRRRGILVTPNPLKRMHLAYSHSEEELEAFHRAAEEAVRVAKEYL

SEQ ID NO: 11376 - protein, 462 aa, Aeropyrum pernix K1
MKAHMPETGPQRDKDGQREGRVLVHYTDIAGYLRQVEVPLRNVEKEFVASFDGSSVYGFTPVEDSDLLLKHVPETLVSVPWRSGLWRVIATVYNATRERSPRDPRLAAETAEKIMSSMGYRVKAGAEIEFFIFDKIGVDVLNPARGLGYIVESREQPGGQDGIFGQVKKSYHMPEPPDSLLDYRLMLTETLQRFKVDVAVSHHEVAVSQVEVSIGSRTSLARLGDDIMTVKWVSKVLARMDGRVATFMPKPIFGDNGSGMHIHLSLWSPGGENLFAGHGDSDLSETALHFIAGILEHARSLSAILSPTTNSYRRLVAGYEAPVYVAWGWRNRSAMIRIPASAGNIDAVRIEVRSPDPTANPYLALAALFMAGLDGVKKKLAPPDPYEGNLYKISPEELREKGIKTLPRNLDEALDELESDNDYLKPAFTREMLESYIEVKRKESEDTRLYPHPIEVYKYLNL

SEQ ID NO: 11377 - protein, 233 aa, Aeropyrum pernix K1
MVEVVSVREHDRWRGVYVVELEDGSLRIATKNLVPGQRVYGERIFRYNGEEYREWNAYRSKLAAALLKGLIELPVKEGDRILYLGIASGTTASHMSDIIGPRGRIYGVEFAPRVMRDLLTVVRDRRNIFPILGDARFPEKYRHLVEGVDGLYADVAQPEQAAIVVRNARFFLRDGGYMLMAIKARSIDVTTEPSEVYKREIKTLMDGGLEIKDVVHLDPFDRDHAMIYAVMRR

SEQ ID NO: 11378 - protein, 423 aa, Aeropyrum pernix K1
MLAGLGEGGRVYIADLAIGPVALRDDGSIEEYELFPRSVDEAVTEALRLEEEGFTLAHEKLGKKLVESGVGSLVVESEDTARHFSKLGLSVKVEPGNNVALSARERLVSLGVELGFFGSEDDALSWLYEVEVEYTRRKLRGAAQKRDMLAAQAIRAIDDIDKTVNLFVARLREWYSIHFPELNDLVREHEDYVKIVSAVGHRDNITVERLVDLGFSEEKARRIAEAAKQSIGADLSEIDIQAVQTLARITSELYQLRRRLTEYIEQVMNEVAPNITALVGPLLGARLISLAGGLDKLARMPASTIQVLGAEKALFRALRTGGKPPKHGIIFQYPDIHRSPKWQRGKIARALAAKLAIAAKVDAFTGRFIGDKLREELRRRIAEIKKIYAKPPKRKREEKPPQPRRARPPRRGRPPRRRRGGRR

SEQ ID NO: 11379 - protein, 359 aa, Aeropyrum pernix K1
MRIEQDFSQSLGVERLKAARLHEYNKPLRIEDVDYPRLEGRFDVIVRIAGAGVCHTDLHLVQGMWHELLQPKLPYTLGHENVGYIEEVAEGVEGLEKGDPVILHPAVTDGTCLACRAGEDMHCENLEFPGLNIDGGFAEFMRTSHRSVIKLPKDISREKLVEMAPLADAGITAYRAVKKAARTLYPGAYVAIVGVGGLGHIAVQLLKVMTPATVIALDVKEEKLKLAERLGADHVVDARRDPVKQVMELTRGRGVNVAMDFVGSQATVDYTPYLLGRMGRLIIVGYGGELRFPTIRVISSEVSFEGSLVGNYVELHELVTLALQGKVRVEVDIHKLDEINDVLERLEKGEVLGRAVLIP

SEQ ID NO: 11380 - protein, 432 aa, Aeropyrum pernix K1
MDVLASGEKSRMLFERTKELFPGGVNSPVRAAVKPYPFYVKRGEGAYLYTVDGARIVDLVLAYGPLILGHKHPRVLEAVEEALARGWLYGAPGEAEVLLAEKILGYVKRGGMIRFVNSGTEATMTAIRLARGYTGRDLILKFDGCYHGSHDAVLVAAGSAAAHYGVPTSAGVPEAVARLTLVTPYNDVEALERVFAEYGDRIAGVIVEPVIANAGVIPPRREFLAALQRLSRESGALLILDEVVTGFRLGLEGAQGYFNIEGDIIVLGKIIGGGFPVGAVAGSREVMSLLTPQGKVFNAGTFNAHPITMAAGLATLKALEEEPVYSVSREAAKALEEAASEVLDRTGLPYTINRVESMMQLFIGVEEVSNAAQARKADKKFYVKLHEEMLRRGVFIAPSNLEAVFTGLPHQGEALEIAVEGLRSSLKTVLGS

SEQ ID NO: 11381 - protein, 510 aa, Aeropyrum pernix K1
MQTQPSLGCLCLVLCPGVRMASPEDAISTEDMRAFEINAENLGVSIELLMENAGNAVAGVLECLLGGLQGAKVAVLAGKGGNGGDGIAAARRLAARGARVEIHLTHPRGEVKHPAARTMLKGVEASRVEVLEPGAPGWLDLGGVDAVVDALLGIGVKGGLRGSVKAAAEAYNKAGGLKISVDVPTGVDPDTGDAVEGAVRSDYTVSMHKPKKGLFKGAAPLYAGEVLTAEIGVPWAAEYYAGPGDVAARIPRRPRDAHKGVGGRVLVVGGSSEYVGAPILAALAAYAAGVDLVYLASPFSREAALARPEIVPRRMEEASRVVERVHAVVAGPGMGGEGEDLLWEVLDAARKRGVPAVVDADGLKALARRGDRLWGGAVLTPHRGEAKLLLGGEDLPPLRAAREIAARYGATTIVKAPVDAVCSPEGRCRESPWGAPEMSVGGTGDVLAGVLAGFLARRRALGLDPDPLNTAAAALYTVGKAGEDLATEEGLVSPLRLVEAVKRVVAGSRT

SEQ ID NO: 11382 - protein, 432 aa, Aeropyrum pernix K1 [sequence omitted]

SEQ ID NO: 11383 - protein, 252 aa, Aeropyrum pernix K1
MAIARPGFSVYLTIAWPSPDTFLEIASTLKGCVDYLELGIPTPKPLYDGPTIRLTHLKAVESGYSGPKTLSLAEEASQEAGVPYIVMAYATEQPWSFSEVLREASRKGALSVLPPDLPFELPGHVEWYVEESRRLGMEPSLFASPKFPHRWLDRYRRLDPLLIYLGLQPATGVKLPLAFLRNVKTARKIVGQVYMLAGFSIKSPEDALRVLEAGADAVVVGSEVARLVSSGRLGEARHLACSIRAAISERGG

SEQ ID NO: 11384 - protein, 366 aa, Aeropyrum pernix K1
MVLKIVYHEDFLKHSPDPYDHPENPSRLVEAVRGLEESGVYKHLEAVTPPVGDVGLYTRVHSPAYLRHVLSTAESGLDWLDPDTYVGPGTLVALKRLGGASVEVYNIVRSGGEALLLGRPPGHHAGIRGRALGAPTAGFCIVNTAALIARMLSEQGKTVILDFDLHHGNGTQEIFYDDPDVYHVDVHQDPTTIYPGTGFPEDIGEGDAKGTKINIILPPNSGDDIYVSAARLALGILERLEPDYIVVSAGFDAYRGDNAFTVMRGGTAMYYLIGSELSRMARRGVAAVLEGGYGVGLRRALPAFAAGLANLENPYPDTEEESPPSVKRMYVAGLKRLAAAIKGLNRVVEEAVLEELERGGWEKRYG

SEQ ID NO: 11385 - protein, 125 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGT

SEQ ID NO: 11386 - protein, 337 aa, Acrosiphonia duriuscula
MPRNRDDSPDGAYLIHGRYEKIEKLGEGTYGKVYKARDSKTDQVVALKKCRLQLDAEGVPPTTIREVSLLQVLSRSNHVVKLLGVEQIEEDGKVVLYLIFEYLQHDLKKFMDFKKKEKHNPLQPELVKPYLFQLIRGMAFMHQHGVMHRDLKPQNLLVDPKTNVLKIADLGLGRVFALPCKAYTHEIVTLWYRAPEVLLGTKIYSLPVDVWSIGCIFAEMVKGIPFFPADCEIAQLFMIFQVLGTPNEEVWPGVTSLRDWHMYPQWQPMDLHTHLEGLLDHQGCDLLKKMLVYNPNKRIPAKQAMKHPYFDDLDMEVMDALENPEVLNAGMEYQENA

SEQ ID NO: 11387 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAEAKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 11388 - protein, 465 aa, Gnidia pilosa
  misc_feature (9)..(10): Xaa can be any naturally occurring amino acid
GFKAGVKEXXLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEIWKEIKFEFQAMDTLD

SEQ ID NO: 11389 - protein, 465 aa, Gnidia aff. renniana Edwards 1492
GFKAGVKEYKLTYYTPEYETKDTDILAAFRVTPQPGVPPEEAGAAVAAESSTGTWTTVWTDGLTNLDRYKGRCYDIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCTEAIYKSQAETGEIKGHYLNATAGTCEEMMKRAIFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDKLD

SEQ ID NO: 11390 - protein, 462 aa, Gnidia denudata
AGVKEYKLTYYTPEYETKDTDILAAFRVTPQPGVPPEEAGAAVAAESSTGTWTTVWTDGLTNLDRYKGRCYDIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCTEAIYKSQAETGEIKGHYLNATAGTCEEMMKRAIFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAADCEVWKEIKFEFEAMDQLD

SEQ ID NO: 11391 - protein, 466 aa, Gnidia kraussiana
VGFKAGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARHGNEIIREASKWSPELAAACEVWKEIKFEFEAMDTLD

SEQ ID NO: 11392 - protein, 465 aa, Gnidia racemosa
GFKAGVKEYKLTYYTPEYETKDTDILAAFRVTPQPGVPPEEAGAAVAAESSTGTWTTVWTDGLTSLDRYKGRCYDIEPVPGEEDQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIREACKWSPELAAACEVWKEIKFEFEAMDKLD

SEQ ID NO: 11393 - protein, 466 aa, Daphne mezereum
VGFKAGVKEYKLTYYTPEYETKDTDILAAFRVTPQPGVPPEEAGAAVAAESSTGTWTTVWTDGLTSLDRYKGRCYNIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFQAMDTLD

SEQ ID NO: 11394 - protein, 461 aa, Dais cotinifolia
GVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTLD

SEQ ID NO: 11395 - protein, 467 aa, Craterosiphon scandens
KASVGFKAGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRAIRLEDLRIPIAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVIPVASGGIHVWHMPALTEIFGDDAVLQFGGGTLGHPWGNAPGAVANRVALEACVQARNEGRDLAREGNEIIREASKWSPELAAACEVWKEIKFEFEAVDT

SEQ ID NO: 11396 - protein, 465 aa, Edgeworthia chrysantha
GFKAGVKEYKLTYYTPEYETKDTDILAAFRVTPQPGVPPEEAGAAVAAESSTGTWTTVWTDGLTSLDRYKGRCYHIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTLD

SEQ ID NO: 11397 - protein, 466 aa, Lachnaea filicaulis
VGFKAGVKEYKLTYYTPEYETKDTDILAAFRVTPQPGVPPEEAGAAVAAESSTGTWTTVWTDGLTNLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRRACKWSPELAAACEVWKEIKFEFEAMDILD

SEQ ID NO: 11398 - protein, 476 aa, Ovidia andina
MSPQTETKASVEFKVGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTLD

SEQ ID NO: 11399 - protein, 467 aa, Passerina falcifolia
SVGFKAGVKEYKLTYYTPEYETKETDILAAFRVTPQPGVPPEEAGAAVAAESSTGTWTTVWTDGLTNLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDKLD

SEQ ID NO: 11400 - protein, 466 aa, Passerina filiformis
VGFKAGVKEYKLTYYTPEYETKDTDILAAFRVTPQPGVPPEEAGAAVAAESSTGTWTTVWTDGLTNLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 11401 - protein, 465 aa, Peddiea africana
GFKAGVKEYKLTYYTPQYETKETDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNAIIREAAKWSPELAAACEVWKEIKFEFQAMDTLD

SEQ ID NO: 11402 - protein, 466 aa, Phaleria capitata
VGFKAGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEIWKEIKFEFQAMDTLD

SEQ ID NO: 11403 - protein, 467 aa, Pimelea ferruginea
SVGFKAGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRALFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFQAMDTLD

SEQ ID NO: 11404 - protein, 466 aa, Struthiola ciliata
AGFKAGVKEYKLTYYTPEYETKDTDILAAFRVTPQPGVPPEEAGAAVAAESSTGTWTTVWTDGLTSLDRYKGRCYDIEPVPGDEDQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIRGACKWSPELAAACEVWKEIKFEFEAVDILD

SEQ ID NO: 11405 - protein, 334 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARTAWC

SEQ ID NO: 11406 - protein, 220 aa, Brassica oleracea var. alboglabra
GGAGGGFGGGAGGGHAGGGAGGGHGGGAGGGFGGGAGGGHGGGAGGGFGGGAGGGKGGGLGGGGGVGGGHGGGVGGGFGGGAGGGKGGGVGGGFGGGAGGGKGGGLGGGHGGGVGGGFGGGAGGGKGGGVGGGHGGGAGGGFGGGAGGGHGGGAGGGFGGGAGGGHGGGAGGGFGGGAGGGHGGGAGGGFGGGAGGGHAGGGGAGGGFGGGAGGGGGGGF

SEQ ID NO: 11407 - protein, 256 aa, Escherichia coli
AEGFNFIGTGVSGGEEGALKGPSIMPGGQKEAYELVAPILTKIAAVAEDGEPCVTYIGSDGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQ

SEQ ID NO: 11408 - protein, 256 aa, Escherichia coli
AEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELTQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQ

SEQ ID NO: 11409 - protein, 407 aa, Glomerella cingulata
MTLITALTAGLALASSVIGAPTNNANEKRFTVDQIKNPRYIRNGPLALAKAYRKYGKALPEDLSRVVANITSTGATKRATGSVAATPQDYDVEYLSPVQIGTPAQTLTLDFDTGSSDLWVFSTSTPSSQRNGQTVYDPSKSSTASRLTGATWSISYGDGSSSSGIVYKDTVSVGSLSVTGQAVEAASKVSSSFSEESDLDGLLGLGFSSINTVSPTQQKTFFETAKSKLDAYLFTADLKHNTPGKYNFGYIDSSAYTGAITYVSIDNSDGWWQFTSSGYSVGSASFTSTSLNGIADTGTTLLLLPQSVVTAYYAKISGAKYDSSQGGYTFPCSATVPSFTFGVGSARVTIPASYMNYAPVSTSTCFGGLQSSSGIGINIFGDVALKAAFVVFDGASNRLGWAAKTLS

SEQ ID NO: 11410 - protein, 486 aa, Pseudomonas putida
MKEFLNFINGEYVRNASGKTFQDINPVNGQVIGNIYEAGQVEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNAVGMPKGVYNVVHGFGPASAGEFLTKHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 11411 - protein, 152 aa, Escherichia coli
DLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 11412 - protein, 154 aa, Fragaria x ananassa
MGGACGYGNLYSQGYGTNTAALSTALFNNGLSCGACYELRCVNDPQWCLPGTIVVTATNFCPPGGWCDPPQQHFDLSQPVFLKIAQYRAGVVPVSYRRVRCRRAGGIRFTINGHSYFNLVLVTNVGGAGDVQSVAIKGSRTRWQMMSRNWGQNW

SEQ ID NO: 11413 - protein, 162 aa, Fragaria x ananassa
MGGACGYGNLYSQGYGTNTAALSTALFNNGLGCGSCYEIRCVNDPKWCLPGSIVVTATNFCPPNNALPNNAGGWCNPPQHHFDLSQPVFQHIAQYKAGVVPVSYRRVPCRRRGGIRFTINGHSYFNLVLITNVGGAGDVHSVSVKGSKTGWQAMSRNWGQNW

SEQ ID NO: 11414 - protein, 162 aa, Fragaria x ananassa
MGGACGYGNLYSQGYGTNTAALSTALFNNGLSCGACFEIKCVNDPKWCLPGSILVTATNFCPPNNALPNNNGGWCNPPQHHFDLAQPVFQHIAQYRAGIVPVSYRRVPCQKKGGIRFTINGHSYFNLVLITNVGGAGEVQSVSIKGSRTNWQPMSRNWGQNW

SEQ ID NO: 11415 - protein, 164 aa, Fragaria x ananassa
MGGACGYGNLYSQGYGVSTAALSTALFNNGLSCGACFEIKCANDPNWCHSGSPSIFITATNFCPPNFAQPSDNGGWCNPPRPHFDLAMPMFLKIAEYRAGIVPVSYRRVPCRKRGGIRFTINGFRYFNLVLVSNVAGAGDIVRVSVKGSRTGWMSLSRNWGQNW

SEQ ID NO: 11416 - protein, 162 aa, Fragaria x ananassa
MGGACGYGNLYSQGYGTNTAALSTALFNDGLSCGSCYEMRCDNDPRWCRPGSIIVTATNFCPPNFAQANDNGGWCNPPLQHFDLAEPAFLQIAQYRAGIVPVAFRRVPCVKKGGIRFTVNGHSYFNLVLITNVAGAGDVHSVSIKGSRTGWQSMSRNWGQNW

SEQ ID NO: 11417 - protein, 352 aa, Brevibacterium sp. HCU
MKAFAMKAQGAALEEIELDRPKPMGREVLLKVTHAGVCHTDTHVQDGGYDLGSRGTLDMSTRGVTYPCVMGHETVGEVVEVGEDVTDVAVGDTCLAFPWIGCGECGKCAHGHENACDNGRALGIIQFGGFAEYLLLPDQRYAIDVAGVDPAWAATLACSGVTSYSSARKATATVNPDEPIGVMGVGGVGMMTVAALVALGHKNIIAIDVSDENLASAQELGATLTVNSKNATSHDLVEAAGGQFIAIIDLVNTGDTVALAFDALSRAGKIVQVGLFGGEFVVPTAIMALKGLTLQGNYVGTVEEVREVVELARQGSLPKLPITGGTLNVDGVNDGLERLRTGRARGRTVLTP

SEQ ID NO: 11418 - protein, 357 aa, Brevibacterium sp. HCU
MSHLLFEPLTLRGLTFRNRIWVPPMCQYSVETLDGVPAPWHTVHYGAMARGGAGAVIVEATGVAPEARISAKDLGWNDEQRDAFVPIVDFLHTQGAAAGIQLAHAGRKASTYPEWGTDRDGSLPVDEGGWQTVAPSALAFDGLAEPRALTETEIAEVVAAFRSSARRAIEAGFDFVEIHAAHGYLLHEFLSPLSNNRTDSYGGSLENRARLLLDIVDATRTEVGEDVPVFVRLSATDWTEGGLTLDDTVEVAGWLKEHGVDLIDVSSGGNVMASIPVGPGYQTTLAAGVRQGSGLPTAAVGLISEPFQGEHILATGQADVILVGREYLRDPNFALRAADALRFDIDYRPAQYHRAYK

SEQ ID NO: 11419 - protein, 325 aa, Aspergillus phoenicis
SKGSAVTTPQNNDEEYLTPVTVGKSTLHLDFDTGSADLWVFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 11420 - protein, 248 aa, Saccharomyces cerevisiae
  misc_feature (168)..(168): Xaa can be any naturally occurring amino acid
MARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 11421 - protein, 123 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAA

SEQ ID NO: 11422 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGAPCVTYIGADGAGHYVKMVHNGIEYGDMQLIVEAYSLLKGGLNLSNEELAQTFTEWNNGELSSYLIDITKDIFTKKDEDGNYLVDVILDEAANKGTGKWTSQSALDLGEPVSLITESVFARYISSLKDQRVAASKVLSGRQAQPAGDKAEFIEKVRRALYLGKIVSYAQGFSQLRAASEEYNWDLNYGEIAKIFRAGCIIRARFLQKTTDAYAENPQIANLLLAPYFKQIADDYQQALRDVVAYAVQNGIPVPTFAAAVAYYDSYRAAVLPANLIQAQRDYFGAHTYKRIDKAGVFHTEWLD

SEQ ID NO: 11423 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11424 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11425 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVVPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSVLDLGEPLSLITESVFARYISSLKDQRVAASKVLSGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11426 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKGEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11427 - protein, 468 aa, Escherichia coli
MSKQQIGVVGMAVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRARFLQKITDAYAEDPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 11428 - protein, 226 aa, Vitis vinifera
VTIFHWDLPQTLEDKYNGWLDPQIIKDFALYAETCFQQFGDRVKHWITFNEPHTFTVQGYDIGLQAPGRCSIPLFLFCRAGNSATEPYIVAHHALLSHATVADIHHKKYKAKQQGSLGVAFDVIWFEPKTNSTEDIEATQRAQDFQLGWFIDPLMYGDYPKSLKDGVGSRLPNFTRDESALLKGSLDFVGINHYTTFYAEYDANNLTGMLLNDSLADNGTILHLAE

SEQ ID NO: 11429 - protein, 510 aa, Oryza sativa
MDGNAKGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDRVALRIFSQIISAVEYCHRNMVAHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIRERQRFQIRLPRYLAVPPPDTAQQAKMIDEDTLQDVVNLGYGKDHVCESLRNRPQNEATVAYYLLLDNRFRATSGYLGADYQESLERNFNRFASSESASSNTRHYLPGSSDPHASGLGPHYPVERKWALGLQSRAQPREIMIEVLKALQDLNVSWKKNGQYNMKCRWSVGYPQATDILDVNHSFVDDSIIMDNGDVNGRLPAVIKFEIQLYKSRDEKYLLDMQRVTGPQLLFLDFCAAFLTKLRVL

SEQ ID NO: 11430 - protein, 400 aa, Mycobacterium vaccae
AKVLCVLYDDPVDGYPKTYARDDLPKIDHYPGGQILPTPKAIDFTPGQLLGSVSGELGLREYLESNGHTLVVTSDKDGPDSVFERELVDADVVISQPFWPAYLTPERIAKAKNLKLALTAGIGSDHVDLQSAIDRNVTVAEVTYCNSISVAEHVVMMILSLVRNYLPSHEWARKGGWNIADCVSHAYDLEAMHVGTVAAGRIGLAVLRRLAPFDVHLHYTDRHRLPESVEKELNLTWHATREDMYPVCDVVTLNCPLHPETEHMINDETLKLFKRGAYIVNTARGKLCDRDAVARALESGRLAGYAGDVWFPQPAPKDHPWRTMPYNGMTPHISGTTLTAQARYAAGTREILECFFEGRPIRDEYLIVQGGALAGTGAHSYSKGNATGGSEEAAKFKKAV

SEQ ID NO: 11431 - protein, 342 aa, Candida albicans
QAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLLDSGTTITYLQQDLADQIIKAFNGKLTQDSNGNSFYEVDCNLSGDVVFNFSFNAKISVPASEFAASLQGDDGQPYDKCQLLFDVNDANILGDNFLRSAYIVYDLDDNEISLAQVKYTSASSISALT

SEQ ID NO: 11432 - protein, 149 aa, Brassica rapa
GTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGPYKGDAKLGDGAAESLSRQGLQVLENSLYMVSGL

SEQ ID NO: 11433 - protein, 435 aa, Aspergillus tubingensis
MRLTHVLSHTLGLLALGATAEAFSRSREAACGPKKPFRPLPTSQSRDKTCHVRSHGDGTDDSDYILSALNQCNHGGKVVFDEDKEYIIGTALNMTFLKNIDLEVLGTILFTNDTDYWQANSFKQGFQNATTFFQLGGEDVNMYGGGTINGNGQVWYDLYAEDDLILRPILMGIIGLNGGTIGPLKLRYSPQYYHFVANSSNVLFDGIDISGYSKSDNEAKNTDGWDTYRSNNIVIQNSVINNGDDCVSFKPNSTNILVQNLHCNGSHGISVGSLGQYKDEVDIVENVYVYNISMFNASDMARIKVWPGTPSALSADLQGGGGSGSVKNITYDTALIDNVDWAIEITQCYGQKNTTLCNEYPSSLTISDVHIKNFRGTTSGSEDPYVGTIVCSSPDTCSDIYTSNINVTSPDGTNDFVCDNVDESLLSVNCTATSD

SEQ ID NO: 11434 - protein, 301 aa, Pantoea agglomerans
MNPDNPLLALRDKISAVDKKLLTLLAERRLLAVEVAQAKLATHRPIRDVERERALLENLIVLGKAHNLDAHYITRLFQLVIEDSVLTQQALLQKNLNHPHAHAARIAFLGPKGSYSHLAARNYASRHFDSMVECGCLKFHDIIKQVENGVADYAVMPIENTSSGSINDVYDLLQQTSLSIVGELTLPIDHCVLVNGPTDLQQIETVYSHPQPFQQCSQFINRFPHWKIEYTESTAAAMEKVAALNSPKVAALGSEAGGELYQLQVLERNLANQQQNHTRFIVLARKAIEVSDQVPAKTTLK

SEQ ID NO: 11435 - protein, 465 aa, Comamonas testosteroni
MTSQTSKQNTDPTVVNVQTVLNESPFSGFQWGIFFLCFLIVLLDGFDTAAIGFIAPSLLGEWGIDKSHLGPVLSAALFGLAFGALGAGPLADRVGRKTVLIIAAVVMGGASIASGLVHDLQGLTIWRFITGLGLGAAMPNAITLMNEYCPDSKRSFITNCMFCGFPIGSAFGGFIAAWMIPHFGWRSLLIVGGVVPLILAVLMIVMLPESVRFMVLKNYSADRVRKVMVRIAAGTRNAARFVLNDGGEAAAQAQQGPQGLRLVFSQKYLVGTLALWVTYFMGLVIVYGLVNWMPVLFKEAGVPASQAAVIAALFQLGGVGAIFVGLLMDRWNANLIIATGYFLTSLGVAFIGQVLGGGVGMLVASVFIAGLLMNAAQSSMQALAAEYYPTECRASGVSWMLGIGRFGGIAGSFLVAELSRRHLELPLVFMVVAIPGVIAALALLVKNRYAGGAPRTSMLGLGGAH

SEQ ID NO: 11436 - protein, 498 aa, Gluconobacter oxydans
MNVVSKTVSLPLKPREFGFFIDGEWRAGKDFFDRSSPAHDVPVTRIPRCTREDLDEAVAAARRAFENGSWAGLAAADRAAVLLKAAGLLRERRDDIAYWEVLENGKPISQAKGEIDHCIACFEMAAGAARMLHGDTFNNLGEGLFGMVLREPIGVVGLITPWNFPFMILCERAPFILASGCTLVVKPAEVTSATTLLLAEILADAGLPKGVFNVVTGTGRTVGQAMTEHQDIDMLSFTGSTGVGKSCIHAAADSNLKKLGLELGGKNPIVVFADSNLEDAADAVAFGISFNTGQCCVSSSRLIVERSVAEKFERLVVPKMEKIRVGDPFDPETQIGAITTEAQNKTILDYIAKGKAEGAKLLCGGGIVDFGKGQYIQPTLFTDVKPSMGIARDEIFGPVLASFHFDTVDEAIAIANDTVYGLAASVWSKDIDKALAVTRRVRAGRFWVNTIMSGGPETPLGGFKQSGWGREAGLYGVEEYTQIKSVHIETGKRSHWIS

SEQ ID NO: 11437 - protein, 391 aa, Rhizopus niveus
MKLTLISSCVALAFMALATEAAPSGKKLSIPLTKNTNYKPSAKNAIQKALAKYHRFRTTSSSNSTSTEGTGSVPVTDYYNDIEYYGKVTVGTPGVTLKLDFDTGSSDLWFASTLCTNCGSSQTKYNPNQSSTYAKDGRTWSISYGDGSSASGILGTDTVTLGGLKITKQTIELAKREATSFQSGPSYGLLGLGFDTITTVRGVKTPVDNLISQGLISKPIFGVYLGKESNGGGGEYIFGGYDSSKYSGSLTTIPVDNSNGWYGITIKGTTIGSSKVSSSFSAILDTGTTLLILPNNVASAVARSYGASDNGDGTYTIDCDTSSFKPLVFSIGSSTFEVPADSLVFEQDGSTCYAGFGYGDYDFAIFGDVFLKNNYVVFNQEVPEVQIAPIA

SEQ ID NO: 11438 - protein, 392 aa, Rhizopus niveus
MKFSLISSCVALAVLVLSTEAAPNGKKVNIPLTKNKDYKPNAKNAIQKVLAKYHRHRSTSSSSNSTSTDGIGRVPVTDYYNDIEYFGQVKVGTPGVTLKLDFDTGSSDLWFASSLCTNCGYSQTKYNPNQSRTYAKDGRAWSISYGDGSSASGILGTDTVVLGGLTIQRQTIELARREASSFQNGPSDGLLGLGFNSITTVRGVKTPVDNLISQGLISNPVFGVYLGKESNGGGGEYIFGGYDSSKFKGSLTTIPVDNSNGWYGVTIRGASIGRSRVAGSFEAILDTGTSLLVLPNDVARSVASAYGARDNYDGTFSISCDTSRFQPLVFTIGSSTFEVPADSLVYEQNGYSCIAGFGYGDYDFAIFDDVFLKNNYVVFNPTVPQVQIATVA

SEQ ID NO: 11439 - protein, 106 aa, Sorghum bicolor
AGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 11440 - protein, 466 aa, Eremothamnus marlothianus
SVGFKAGVKDYKLTYYTPDYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAVEGNEIIREATKWSPELAAACEVWKEIKFEFQAVDTI

SEQ ID NO: 11441 - protein, 370 aa, Bacillus halodurans
MSKRDYYEVLGVDRNASADEVKKAYRKLARKYHPDVNKAPDAEDKFKEVKEAFDTLSDPQKKAHYDQFGHTDPNQGFGGGGAGDFGGFSDIFDMFFGGGGGRRNPNAPRQGADLQYTMTLEFKEAVFGKETTIEIPREETCHTCSGSGAKPGTKPESCPHCGGSGQLNIEQNTPFGRVVNRRVCHHCEGTGKYIKHKCATCGGKGKVRKRKKINVKVPAGIDHGQQIRLSGQGEAGVNGGPAGDLYIVFNVKPHEFFERDGDDIYCEMPLTFVQVALGDEIEVPTLNGKVKLKIPAGTQTGTSFRLRGKGVPNVHGRGQGDQHVQVRVITPKQLSEKEKELLREFAQMSGGRPDEQDDSFFAKVKRAFKG

SEQ ID NO: 11442 - protein, 335 aa, Citrus unshiu
MEVERVQAIASLSHSNGTIPAEFIRPEKEQPASTTYHGPAPEIPTIDLDDPVQDRLVRSIAEASREWGIFQVTNHGIPSDLICKLQAVGKEFFELPQEEKEVYSRPADAKDVQGYGTKLQKEVEGKKSWVDHLFHRVWPPSSINYRFWPKNPPSYRAVNEEYAKYMREVVDKLFTYLSLGLGVEGGVLKEAAGGDDIEYMLKINYYPPCPRPDLALGVVAHTDLSALTVLVPNEVPGLQVFKDDRWIDAKYIPNALVIHIGDQIEILSNGKYKAVLHRTTVNKDKTRMSWPVFLEPPADTVVGPLPQLVDDENPPKYKAKKFKDYSYCKLNKLPQ

SEQ ID NO: 11443 - protein, 444 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNGIKNNGLTD

SEQ ID NO: 11444 - protein, 1102 aa, Klebsiella aerogenes
MLRYTCHALFLGSLVLLSGCDNSSSSSTSGSPGSPGNPGNPGTPGTPDPQDVVVRLPDVAVPGEAVQASARQAVIHLVDIAGITSSTPADYATKNLYLWNNETCDALSAPVADWNDVSTTPTGSDKYGPYWVIPLTKESGCINVIVRDGTNKLIDSDLRVSFSDFTDRTVSVIAGNSAVYDSRADAFRAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELVRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 11445 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDQFVDKTVYDDGRIDYVKQHLEVLSDAIADGANVKGYFIWSLMDVFSWSNGYEKRYGLFYVDFDTQERYPKKSAHWYKKLAETQVIE

SEQ ID NO: 11446 - protein, 405 aa, Beta vulgaris
MRSKPLINPISITIMLSISIFFILFFSGFFQVPSFASPSIIDQTIKSNKPDPFTDLLGAFRKWDSQMGCLKFREKYQNWGFSNASVSLQFSRIDEVGCDKELKLKHVNVLVKGWTWIPDNLENLYECKCGLSCFWTKSSVLSDPPDALLFETTTPPLQRRVGDPLRIYMDLEAGRKRSGREDIFVSYHAKDDVQATYAGALFHNNRNYYVSSWKKNDTLVYWSSSRCLPERNDIAKRLLSLLSHHSFGKCLNNVNGLDKALYMYPECAKDPNSAPKWWDHLHCAMSHYKFVLAIENTMTESYVTEKLFYALDSGAVPIYFGAPNVWDFVPPHSIIDGSKFSSLEELASYIKALANDPVAYAEYHAWRRCGVLGNYGKTRATSIDTLPCRLCEAVSRRGGRSARAL

SEQ ID NO: 11447 - protein, 479 aa, Streptomyces coelicolor A3(2)
MSTTAQIGVTGLAVMGRNLARNFARNGYTVAVHNRTASRTHALVEEFGSEGDFVATETAKEFVAALERPRRLVIMVKAGDPTDAVIREFAPLLEPGDMIIDGGNAHFADTRRRERELREQGIHFVGTGISGGEEGALHGPSIMPGGSKESYESLGPMLEKISAKAADEAPCVTHVGPDGAGHFVKMVHNGIEYADMQLIGEAYQLLRDVAGYSPAQIAEIFRAWNTGRLDSYLIEITAEVLSHVDGATGKPFVDVVVDQAEQKGTGRWTVQIALDLGVPVSGIAEAVFARSLSGHAALRDASRGLAGPQASPLGESEAAAFADRVEQALYASKIVSYTQGFHEIAAGSEEYDWDIDLGAVSAIWRGGCIIRAAFLDRIRAAYDARPDLPSLLSDETFAQEIAAAQDDWREVLVAATRQGVPTPGFAAALAYYDALRAERLPAALTQGQRDFFGAHTYRRTDRDGAFHTLWGGDRSEVTA

SEQ ID NO: 11448 - protein, 466 aa, Anomatheca laxa
AGFKAGVKDYRLTYYTPEYQTKDTDILAAFRVTPQPGVPAEEAGAAVAAESSTGTWTTVWTDGLTSLDRYKGRCYHIEAVIGEENQYIAYVAYPLDLFEEGSVTNMFTSIVGNVFGFKSLRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDYIEKDRSRGIFFTQDWVSMPGVLPVASGGIHVWHMPALTEIFGDDSVLQFGGGTLGHPWGNAPGAVANRVALEACVQARNEGRDLAREGNEIIREACNWSPELAAACEVWKEIKFEFEPVDKID

SEQ ID NO: 11449 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTGVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 11450 - protein, 218 aa, Paracoccus denitrificans
MAINIILLGPPGAGKGTQARRLIDERGLVQLSTGDMLREARSSGTEMGKRVAEVMDRGELVTDEIVIGLIREKLGQGGKGFIFDGFPRTLAQADALQALMAEMDQRIDAVIEMRVDDAALVSRISGRFTCGNCGEVYHDVTKPTKEPGKCDVCGSTDLRRRADDNEESLKTRLMEYYKKTSPLIGYYYVKGNLNPVDGLAEIDEVAAQVAKVMDKIPA

SEQ ID NO: 11451 - protein, 488 aa, Prunus dulcis
LPTEDDMGNSEVGHNALGAGRIFAQGAKLVDSALETGKLYEGEGFKYIKESFPTNTLHLIGLLSDGGVHSRLDQLLLLVKGASERGAKRIRVHILTDGRDVLDGSSVGFAETLENYLAQLREKGVDAQIASGGGRMYVTMDRYENDWGVVKRGWDAQVLGEAPHKFKNAVEAIKTLRQEPNTSDQYLPPFVIVDENGKPVGPIVDGDAVVTFNFRADRMVMIAKALEYADFDKFDRVRFPKIRYAGMLQYDGELKLPSKYLVEPPEIDRTSGEYLTYNGVRTFACSETVKFGHVTFFWNGNRSGYFNPQMEEYVEIPSDSGITFNVQPKMKAVEIAEKGRGAILSKKFEQVRVNLPNSDMVGHTSSIEATVVACKAADEAVKIIIDAIEQVGGIYVVTADHGNAEDMVKRNKKGQPLLDKNGNIQILTSHTLQPVPIAIGGPGLAPGVQFRKDVPNGGLANVAATVMNLHGFEAPADYETTLIEVVDN

SEQ ID NO: 11452 - protein, 197 aa, uncultured crenarchaeote 15G10
MGHWSLILGHGQKNVKESIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIISIPYNNLEVSLKILKKHSKNLAGVIIEPVLGGGGCISATKEYLKGIQEFVHKNKLLFILDEIVTGFRFRYGCLYPTMKLDP

SEQ ID NO: 11453 - protein, 198 aa, uncultured crenarchaeote 31B02
MGHWSLILGHGQKNVKDAIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIVSIPYNNLEGSLKILKKHSKNLAGVIIEPVLGGGGCIPATKEYLKGIQEFVHKNKSLFILDEIVTGFRFRYGCLYPTMKLDPD

SEQ ID NO: 11454 - protein, 198 aa, uncultured crenarchaeote 83A10
MGHWSLILGHGQKNVKDAIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIVSIPYNNLEDSLKILKKHSKNLAGVIIEPVLGGGGCIPATKEYLKGIQEFVHKNKSLFILDEIVTGFRFRYGCLYPTMKLDPD

SEQ ID NO: 11455 - protein, 469 aa, Clostridium acetobutylicum ATCC 824
MRHSKLKDFPKDFLWSASTSAYQVEGAWNEDGKGMSVQDAKTSLPEGTSDFKVASDHYHHFEEDIAFLGEMGLKAYRFSISWTRIIPDGDGKINTKGVQFYHKLIDACLSYNIEPIVTMYHFDLPFELEKKGGWNNRTTIDAFLKFSKILFEQYGSKVKYFLTINEQNMMILHGAAIGTSKGSGINIWKELYQQNHNMLVAQAKAMELCHKLCPNSKIGPAPNIASIYPASSKPEDYLAAQNFTAIRNWLYLDMAVFGRYNSTAWSYLEEIDAVPKIEEGDMEILRNAKPDFIAFNYYNTATVKANNDAKKVQDSSGDQQLAVFEAGVFEGVQNPNLEKTEFGWEIDPVGFRITLREVYDRYNLPIIVTENGLGAFDKLEDGTVHDDYRIEYYKKHLHEIKEAITDGVKVFGYSPWSAIDLVSTHQGVTKRYGFIYVNRDEFDLKDLKRYKKDSFYWYKKVIEENGNNL

SEQ ID NO: 11456 - protein, 370 aa, Oryza sativa
MPTPSHLKNPLCFDFRAARRVPETHAWPGLDDHPVVDGGGGGGEDAVPVVDVGAGDAAARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 11457 - protein, 412 aa, Petunia x hybrida
MSSCKEEDTQQKWLWVNGPIIIGAGPSGLAVSACLKENGVPSLILERSDCIASLWQHKTYDRLKLHLPKQFCQLPLFGFPDNFPKYPTKRQFISYLESYAKHFSINPKYKQAVQVAEFDHVSGFWKVQTQNFQYFSKWLIVATGENAEPVIPNIQGMDKFKGPVMHTSLYKSGTEFNNQRVLVIGCGNFGMEVSLDLCRHNAIPHMVARNSVHILPREMLGISTFSMAMALLKCLPLRIVDKFLLLVANLTLGNTDKLGLRRPKTGPIELKNATGKTPVLDVGALSQIKAGKIQIVHAVKEITKIGAKFVDGKEGEFDSIILATGYKSNVPSWLKGTEFFTEQGMPKTPFPNGWKGENGLYTVGFTRRGLLGTACDAKNIARDIGDEWRKYKGFCKNFCISRNLSDSQGICF

SEQ ID NO: 11458 - protein, 479 aa, Streptomyces coelicolor A3(2)
MPASRVKSPHLLVAESGADREGHGLKRTMGLFQLVCFGVGAIVGTGIFVGLSDSVAEAGPAVVVSFVLAAITCVFTAFAFAELGGAIPVSGSSYSFAYAGLGERTAFLVGWCLLLEYGVSVSAVAVGWSQYVNELLDTVLGVQLPHALSAGPGDGGAVNLPAVVVIALASVLLMRGVRESARATAAMAVLKLAVLLAFCAIGFYAFQDGNLTPFSPAGLGGIGAGTTAAFFSYIGFDAITTAGEEAKNPRRDIPVAILVCIGLVTLLYCAVAVAAIGAVGGDQVGNRPAALSYVVDRVTGSAIGGGVVAFGAVVAIASVVLAVMYGQTRILMSMSRDGLIPRVFEKVSPRTATPVAGTLIVGVVFALPAAFAPLDAVVNLCTIGTLATMAAVNVSVITLRRREPGLARTFRVPLYPATPLLGVGFCLYLMYETGGATWLQFAVFLAVGLLVYSAYGRRHSRLARTAVSADDAERVPQEA

SEQ ID NO: 11459 - protein, 465 aa, Holboellia grandiflora
VGFKAGVKDYKLTYYTPDYITKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAESIYKSQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGPVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 11460 - protein, 465 aa, Holboellia parviflora
VGFKAGVKDYKLTYYTPDYITKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAESIYKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 11461 - protein, 305 aa, Clostridium acetobutylicum ATCC 824
MIRILANDGMNKNAVNGLIDLGYEVVEDHYDKDELLVKIKEFDVLVVRSATKVTKEVIDAATVKGAKLKLIIRAGVGVDNIDVTYARDKGLTVNNTPNASSASVAELAIGHMFAVSRFINTANVTMRQGKWEKKAYTGTEIFGKTLGLIGFGRIAREVAKRAEALGMKVIYNDICGKVVGYDSYEFYDDINGLLREADFVSLHIPYDKKKGYVIGDNEFNAMKDGAFLINCARGGVVSEQALLNAINNGKIRGAALDVFENEPKPCAEILDNPRVSVTPHIGASTKEAQARIGEEIVNIVENTFK

SEQ ID NO: 11462 - protein, 318 aa, Clostridium acetobutylicum ATCC 824
MRISVIEPLGISEEEIRSIAKTITDRGHEIVIYNEKSTDTNVLKERVKDSEVIVLANMPLKAEVINSDSKLKMMSIAFTGVDHVELSALNNKEVVVSNASGYSTESVTELTFGLVFSVLRNIVPLDKVTREGKTKNGFSQSDLSGKTFGVIGTGLIGASVCRIAKAFGCKVIAYSRSKKEELEVIGVNYVTLDELLAKSDVISVHVPQTQETIGMISKEKIKLMKKTAILINVARGPIVDNEALAEALENGTIAGAGIDVFDKEPPLDLGYRLLKAPNTVVLPHVGFATKEAMVRRAHITFENIVKWLDGTPQNIVKY

SEQ ID NO: 11463 - protein, 422 aa, Clostridium acetobutylicum ATCC 824
MTNKEIFEESKEYMPGGVNSPVRAYMDLNIDPPIIKSGKDSHLFDEEGKEYIDFIEAWGPMILGHKNQKVLNEVKEVLDEGVGFGAPTSLELKLAKYICTTVDNVEMIRMVNSGTEATMSAVKLARGYTKRDKIIKFAGCYHGHFDGFLVEAGSGVLTQNIPGSPGVPKGSIENTLIAEYNNVESVEVLFNKYKDEIAAVIIEPVAGNMGVIPAKKEFLVKLRELCTENQSILIFDEVMSGFRVAYKGAQSLYGVTPDLITFAKIMGGGFPCGAYGGKKEIMKQLSPLGPVYQAGTMSGNPVVMAAGYASLRQLHENPEYYTYMDKLGSKLEAGILEISKEKGIPLVVNRCVNMMTIFFNKAKEVKSYSDAKASDTKMFARFAEHMITSGIYVPPSQFEAMFLGVKHTEEDIERFLDVMKKL

SEQ ID NO: 11464 - protein, 245 aa, Clostridium acetobutylicum ATCC 824
MSKDLAIEVKELKKSYGSNEVLKEINLTIDRSEVVCIIGPSGSGKSTLLRCMNRLEEITAGQLMIDGKDISDKNINIDKLRENVGMVFQHFNLFPHLSVLKNITFAPIELNKMSKEEAEKTAFKLLDKVGLNDKANTYPDKLSGGQKQRVAIARALAMNPDIMLFDEPTSALDPEMVGEVLGVMKDLAKEGMTMVVVTHEMGFAREVADRVIFMADGYIVEQGTPDDIFKNPTQDRTKDFLNKVL

SEQ ID NO: 11465 - protein, 351 aa, Clostridium acetobutylicum ATCC 824
MKKLFTEINIKNLKIKNRVCIPPMVVPVAEDGYVTSSNVERYKELAKGGPGLIIQEATCINEDGKLAEKQIGIWSDDQVEGLRKIVDAVHEEGCPIFVQIHHAGVVGISEEPLCPSPYEFNGYGRKVVGREMTLEDIKSVQNDYIEAARRAYEAGYDGIELHGCHGYLICQFLNKRVNKRNDEYGKNPENFVIEILEGIRKVTPKEFIVGIRLGGFEPAIEDGIHYAKIFEQQGIDFLDVSYGFSNGQEINVGEDYKYSNAVYAAERIKKEVSVPVFAVDGINSGDMAEAILNETNVDLVDIARGALINPNWANDAREGKDTGKCLRCSKCAWFGLSKACPGRAIFSRNNA

SEQ ID NO: 11466 - protein, 275 aa, Clostridium acetobutylicum ATCC 824
MKKAAVLGPKGTFSEFAVKEYKNKIDNNIEMIFCSTISKVVKAAEEECDIAIIPIENTLDGFVQVTLDLLSKTNLNIIYELVLPIQFAFAANSKMEEVQRVYAQFKTQGQCCEFLEKHDEFKIITTESNGQSLKKLKEGVLGEGAIVPAYAVKGTNKFKCNINNVTDSEGNETRFIVLSKEKVQYEGKGYYKTGIIISDANADKPGTLWRVLNEFSVRDINLTSIISRPTKKGLGQYYFFIEVDGCYFKDNRLNEAVEAIKHHSVVKVVGTYYKI

SEQ ID NO: 11467 - protein, 513 aa, Clostridium acetobutylicum ATCC 824
MNFNLVTATSTSASFEIENNKCFYLESTADVYMNNERILTTDKNVFTLNNLTPGTEYSIFIEDTESKAKSPVISIKTKLESAVVNILDFGAVGDGNHVNTAFIQAAIQVCPAFGRVIIPKGTYLTGPLFLKSNITLELEEGSVLLGLKEREHYPILKANISMTNRDFYLGSWEGNEADCFASLITAINVENVNIIGKGTIDGNSDFDTWWFKAKEKRIAWRPRTLFLNACKNILVEGVTIKNSPSWTIHPLMSDHLKFINLSIENPFNAPNTDALDPESCKNVLILGDTFSVGDDCIAIKSGKIDISKKNPVSSENINIRNCNMRSGHGAVVLGSEMSSGLKSIFIEKCIFNATDRGLRIKTRRGRGSKGIIDNIHMKNIKMDKVLTPFSINSFYFCDDDGKTEYVWSKEKLPVDDKTPYIGSIYVEDVTCTNAHVCAAFMYGLPEQKIEKVSMKNVSVSFDENAKEDYADMMSFLEPMKRNGMYFNNIKDLVLENVTVEKALNEEITKLNIG

SEQ ID NO: 11468 - protein, 428 aa, Clostridium acetobutylicum ATCC 824
MKMSSLYERSLKVIPPVAGRATKLGVVRGEGAYLYTEDGRKVLDFASGVAVCNLGHNNPAVIKAAKEQMDKLIHGGHNVVYYESYVKLAEKIVELTGNKTMVYFSNSGAEANEGAIKLAKYITKRQAIISFKGSFHGRTLATTSITGSSSKYRKNYEGLLPSVYFAEYPYCFRCPYKQNKESCNMECISQFEDMFKKLIEPESVAAIIMEPVQGEGGYIVPPKKFLKAVREICDKYGICLIFDEVQCGFGRTGKIFAHENFEVEPDIFTCAKAIASGFPLSAVIGKKELMEKWPAGAHGGTFGGNPVACAASLATIKELESGVLDNANNMGNYLKEELLKLKDKYACIGDIRGIGLMIGMEFCKENNNPDGDIVTFIREVAVNNNLILLGCGTEHNVLRFIAPLTVEKSEIDMAISIVEKGIVEYLNK

SEQ ID NO: 11469 - protein, 243 aa, Clostridium acetobutylicum ATCC 824
MSMIETCGLTKVFGKLTVFKDLNIKVKRGEVLVIIGPSGSGKSTFLRCINHLEIPEKGSVVIEGEKIDSKNKKTYKGIIEKMGMVFQGFNLFPHMTVLENVMEAPITVKKEAKAVVKKRAEELIDKVGLIDKCNVYPSKLSGGQKQRVAIARALCMQPDIMLFDEPTSALDPELVGEVLNVMKDLAREGMTMVVVTHEMGFAREVSDRVIFMDGGKIVEEGKPEDIFNNPKEERTRAFLNKIL

SEQ ID NO: 11470 - protein, 469 aa, Clostridium acetobutylicum ATCC 824
MKFPKDFFLGAASASYQVEGAWNEDGKGVSNWDVFTKIPGKTFEGTNGDVAVDHYHRYKEDVKLMAEMGLDSYRFSVSWPRIIPDGDGEINQKGIEFYNNLIDECLKYGIVPFVTLYHWDMPEVLEKAGGWTNKKTVDAFVKYAKACFEAFGDRVKRWITFNETIVFCSNGYLSGAHPPGITGDVKKYFQATHNVFTAHARSVIEYKKLKQYGEIGITHVFSPAFSVDDKEENKAAAYHANQYEITWYYDPILKGKYPEYVIKNIEKQGFLPDWTDEELNTLREAAPLNDFIGLNYYQPQRVIKNHDTGEKIERTRENSTGAPGNASFDGFYRTVKMDDKTYTKWGWEISPESLILGLEKLKEQYGDIKIYITENGLGDQDPIIEDEILDMPRIKFIEAHLRAIKEAISRGINLKGYYAWSVIDLLSWLNGYKKQYGFIYVDHKHNLDRKKKLSFYWYKKVIEERGKNI

SEQ ID NO: 11471 - protein, 502 aa, Clostridium acetobutylicum ATCC 824
MKVGTSKIMNKIDQFCTTSLGIPGNILMENAALKVVKNIGEEFKDIVLVCGVGNNGGDGMACARHLNAIGRNLKIFCVGNIEKMSSDCKFNYDILSNIGIQVINLANEDDLEEFKTAVQSADLILDCIFGTGLSREVKGIYRDVISIINDEGNYIMAVDTPSGLSSDTGIEMGIAIKAHKTISFVMYKRGFFRYRSEDYTGEIVIENIGVPKFVIDKFHENEYIVDEEMASNSIIKRDKYAHKGNFGRVAIFAGAKGYSGAAYISTEAAVRSGSGLITLCTKEELQNLLSSKLVEAMTASFNDKEKIEKIITSSDAIAVGPGMGNTEETFYKVKEILSTACCPIVIDADGINVLKGRLDTLKNSKNKVILTPHPGEMSRISGVSIEKLEKNRIDIAKNFAAKYDVIIVLKGYKTVITDGKEVFVNTTGSSYMASGGMGDCLTGIIVSLVGQGYSPIMAAAIGTFIHGYCGDVLANKMANITASDILKEIPYSIKKISYNKMR

SEQ ID NO: 11472 - protein, 473 aa, Clostridium acetobutylicum ATCC 824
MQKTKMIFTVGPASETEEIVTAFIKAGMNASRHNFSHGDHAEHGGRIALVKKVRAKLNKPVAICLDTKGPEIRTGDFNPSKLELQKGSKFTIVCGEEIVGDATKCSISYKDLYKDVKPGNTILIDDGLVGLTVEAIEGTNVICTVANTGLVGSHKGVNVPNVSIQLPAMTEKDKSDLIFGCKEEIDMVSASFIRKPEDVLAIRKVLNENGGENIQIFSKIENQEGVDNIDAIIEVSDGIMVARGDMGVEIPIQRVPLIQKMIIKKCNAVGKPVITATQMLDSMMRNPRPTRAEASDIANAIFDGTDAIMLSGESANGSYPIEAVTTMAKIAQEAENEINYDKFLAERKGNEKKNTSDVISLGTCTAAADLEASAIITATQTGSTARTVSKYRPKAPVIAVTPSEKVARKLAMSWGVHPIISDKFGSTDELISTSVDKALEAGYVQKGDLVVVAAGVPTNVSGTTNMLKVQVVE

SEQ ID NO: 11473 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 11474 - protein, 397 aa, Clostridium acetobutylicum ATCC 824
MKFNKKTIEDVDVKGKRVLVRCDFNVPLKDGVITDENRLNGALPTIKYLSEHGGKVILCSHLGKAKGPDPSKTLAPVAKRLSELLGREVKFAADDTVVGENAKKAVAELKEGEIVLLENTRFRPEEGKNDDAFSKDLASLADVYVNDAFGTAHRAHCSTVGVTKFVDTAVCGYLIQKELKFLGSAVENPVRPFVAILGGAKVSDKINVINNLLEKVDTLIIGGGMAYTFLKAQGYTIGTSLLEADKVDYAKEMIEKAEAKGVKLLLPIDNIVGAEFKADTKAVTTEDANIPEGYMGLDIGPKTQKLYADAVKEAKTVVWNGPMGVFEFENFAKGTKDVAKAMAESDATTVIGGGDSAAAVNQLGFGDKMTHISTGGGASLEFLEGKELPGIVALNDK

SEQ ID NO: 11475 - protein, 248 aa, Clostridium acetobutylicum ATCC 824
MRTPIIAGNWKMNNTISESLKLIEELKPLVKDAKAEVVVAPTAVSLETVVNATKGSNIKVAAQNAHFEESGAFTGEISLKALEELGVSYVILGHSERRQYFNETDCALNKKVKAAFAHNITPILCCGETLEEREANVTNEVTGKQIKLDLAGLSAEQAAKVVIAYEPIWAIGTGKTATDEQANETIGAIRKTVEVMFGKEVAEKVRIQYGGSVKPNTIKAQMAKPEIDGALVGGASLKAADFAAIVNF

SEQ ID NO: 11476 - protein, 510 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATYDLKPEMSAYEVTDELLKRLDEDKYDMVILNFANPDMVGHTGILEAAKKAVETVDECLGKIVDKVLKLDGSVFITADHGNSEQMIDYSNGKPMTAHTVNPVPFVYVSNHTEAKKLNEGVLADIAPTMLQEMGLEKPEEMTGKSLFE

SEQ ID NO: 11477 - protein, 431 aa, Clostridium acetobutylicum ATCC 824 [sequence omitted]

SEQ ID NO: 11478 - protein, 460 aa, Clostridium acetobutylicum ATCC 824
MEKKELSRGLKARHIELIALGGTIGVGLFMGSASTIKWAGPSVLLAYGVAGIAMYIIMRIMGEMLYLEPLAGSFANYANKYISPLAGYITAWCYWFMWIAVGMSEITAIGIYVKFWFPALPAWIPALIGVAILAAANMASVKFYGEFEFWFSLIKVVTIVVMLIVGVGLIFFGIGNHGVPIGFKNLTAHGGFFAGGLKGWLFALCMVTASYQGVELIGITAGEAQDPKNTLRKATKNIIWRILIFYVGAIFVIVTIYPWDKISTLGSPSVLTFAKIGIAAAAGIINFVVLTAAMSGCNSGIYSCGRMLYTLATNGQAPKFLGKLNKDGVPANGIRTTLVCLLIGVILNYIYPNSKLFVYIYSASVLPGMAPWFVLCISQIKFRKEHAEEMKMHPFKSRLFPYANYIVVAYLCLVLIGMCFNSSTQIPLFIGAVFCAIVTIAYFAFGIHKGKVSKVEELQE

SEQ ID NO: 11479 - protein, 471 aa, Clostridium acetobutylicum ATCC 824
MGVKFPEGFLWGGATAANQFEGAYNQDGKGLSIQDIMPKGIRGPITDKPTEDNMKLIGIDFYNRYKEDIKLFAEMGFKTFRLSIAWSRIFPNGDDKQPNEKGLQFYDNVFDELAKYNIEPLVTISHYETPLALAKNYDGWTNRKLIGFFENYVRTIFNRYKNKVKYWLTFNEINSALHAPYMSAGIWTPKEKLSKQDLYQAMHHELLASALAVKIGHEINPEFKIGCMILGVPNYPLTSKPSDVLKAMNQDRENLFFADVHARGRYPKYMNRLFKENNVHIKMEPGDEEILKNTVDFISFSYYMSSCATSDTKKSKGGAGNIISGVPNPYLKASEWGWQIDPEGLRYILNLLYDRYQKPLFIVENGLGAVDELITDERGNKTVNDDYRINYLNDHLVQVGEAIEDGVELMGYTTWGCIDLVSASTAELKKRYGFIYVDRHDDGSGTLERYKKKSFYWYKEVIATNGASLKK

SEQ ID NO: 11480 - protein, 411 aa, Clostridium acetobutylicum ATCC 824
MDNPNLLSEEANRCLLCKNPRCKANCPINTPIPEIISLYKEGKIMEAGEILFNNNPLSVICSLVCIHEDQCKGNCVRGIKSEPIKFHEIEEEISEKYLKEAKLKNVQKDKDRIAIVGGGPAGITVAFVLANKGYNVTIFEAHDKIGGVLRYGIPEYRLTKKLVDKLEERLIEVGVKIRPNTVIGPVISLDRLLEDSYKAVFIGTGVWNPKTLDVKGETLGNVHFAIDYLKSPESYRLGKKVAVIGAGNVAMDAARTAKRNGAEVTILYRKSFNEMPASKQEIRETKEDGVEFKLFRAPIEITEEGIKVAFTENVTDAEGKIRTKIIEGKEEFFECDSVVVAVSQAPKDNIVSNTTGLDTKWGLIVTDEKGNTTKKGTFACGDVVTGAKTVVEAAAQAKVVAETIDEYCKNN

SEQ ID NO: 11481 - protein, 242 aa, Clostridium acetobutylicum ATCC 824
MHYSLAVKLVCEMLGTAILVLFGNGAVANVELKGTKGYRNGWIIIAIGYGVGVMLPALMFNKISGSQTNPAMTIGLAVNGLFPWSEVIPYILAQFVGAIIGQVILYFIYLPFYKQTEDTKSILGTCSTISASGSHINGFVTEFFGTFLLVLGAMFILNSTGVKSTPAVGYVGLGFLVCSLVASLGGPTGPGLNPARDLGPRIVHSLLPLKNKGNSEWTYAWIPVLAPMFGSIIAIFLFNKIY

SEQ ID NO: 11482 - protein, 352 aa, Clostridium acetobutylicum ATCC 824
MEKDILIELKNVSKKYGENYVIKNLNLFVRRNEFLTFLGPSGCGKTTTLNMIAGFETPDEGNIIFEDSSINIVPPHKRQINTVFQKYALFSHMNVYENVAFGLRIKKLPEKQIREEVEKMLSLVDLKGFEKRSTDSLSGGQQQRVAIARALVNKPKLLLLDEPLGALDLKLRKEMQLELKNIQQKLGITFIFVTHDQEEALTMSDTIVVLNKGTVQQIGTPEDIYNEPKNKFVANFIGVSNILNGVMLHDYKVKFDDETFDCVDTGFNENEDVDVVVRPEDIKIVSKENGKLFGKVISAVFRGVHYEIKVEVKNTTWIIHNTKHVRVGDSIGLDILPDDIHIMRKEKIDEEA

SEQ ID NO: 11483 - protein, 243 aa, Clostridium acetobutylicum ATCC 824
MIKIESLHKTYGDNEVLKGISLEIKAGEIVAVIGPSGTGKSTFLRCLNYLERPDSGTLLIGDVRVDFENISKDEVYSLRKKTSMVFQNYNLFKNKTALENVMEALRVVKKMPKDEAEKVSLEALKQVGLLDKANSYPSRLSGGQQQRIGIARAMVLKPEIILFDEPTSALDPEWVGEVLDVIKGIASRHLTMIIVTHEMSFAREIADKIVFLDGGKIIQYGTPEEVFEKSNNDRVNQFIKKLH

SEQ ID NO: 11484 - protein, 303 aa, Clostridium acetobutylicum ATCC 824
MNYIDDIRQIIGNTPIIKINNFGLNSGVNIFAKLELLNPGGSVKDRVGVYMIEDAEKKGKLKKGYTIVEGTAGNTGIGIALAAINKGYNVIFVVPEKFSIEKQTLMKAFGAKIINTPREEGMQGAVKKANELLSTIPNSISLGQFVNQANPLAHYETTGPEIYRDLEGNIDYVVAGAGSGGTYAGVLKFLKEKKPNIKGVLADPEGSTMGGGEEASYDIEGIGNDFIPDTMDMNLVDEVIKVNDAEAFHMVRQLALKEGLIVGSSSGAAMAAAIKLSKKIKSGNIVTIFPDRGDRYFSKNILG

SEQ ID NO: 11485 - protein, 115 aa, Clostridium acetobutylicum ATCC 824
MEYKKILEMMDFSKGLIPAIVQDDENGEVLMLAYMNEEALKRTVDTKRTWFWSRSRKSYWNKGETSGHFQYVKSIGIDCDGDTILIKVKQVGAACHTGNRSCFYRSFEFEDGGAK

SEQ ID NO: 11486 - protein, 493 aa, Clostridium acetobutylicum ATCC 824
MEFKKNFDIKDDRNLTMLVDFYELTMGNGYLNKNVGNKTAYFDMFFRRVPDNGGYCIMAGVQQLTEYLSNLRFTKEDIDYLRSKHEFSEEFLSYLKDFKFECDVWAVPEGNPVFPNEPLVTVKGPAIQAQFVETMILLTINHQTLIATKANRICRAAGNRPVMEFGSRRAQGYDGAIYGARAAVIGGCSSTACTISEQMFGVNAVGTMAHSWVQLFDNEFEAFKAWADVYPENCVLLVDTYNVLKSGLPNAIKVFDEVLKPKGIRPSGIRIDSGDITYLTKKCRKILDEAGYSDCKIVISNSLDEHIITDVLLQGAEVDSFGVGERLITAKSEPVFGGVFKLCAVENDEGNIVPKIKISENQEKITNPGFKKIYRLFDKETDKALADLITLNDEVIDETKPLEIFDPIYTWKKKKLTHYYVKDLRVQLFKKGELVYENPEVLEIRNIAKKETEKLWAEVLRLENPHTYYVDLSKKLWDLKHNLLEKYSNAFNS

SEQ ID NO: 11487 - protein, 472 aa, Clostridium acetobutylicum ATCC 824
MQKTKMIFTIGPSSDSEEKLKELMNAGMNAARLNFSHGTHEDHKEKIDIIKKLRKELNKNVAIVVDIKGPKIRTHNFENDKAEIKKGQTFTVMCGSEILGNSEKCSVSYDDLYKDVKKGGLLLVDDGLLEFEITDVQDKNIICKAKNNGIISNHKGVNVPGVSIGLPAVTEKDVLDLKFACKMQADLVAASFIRKAEDVSVVRKVLKENGGEDIRVISKIETQEGVDNIDKILELSDGIMVARGDMGVEIPIEDVPSIQKMIIRKCNDAGKIVITATQMLDSMIRNPRPTRAEASDVANAIYDGTDAIMLSGESASGLYPIEAAETMAKIAQKTESQIDYTKALNERKGEIITKISDAISLAACSTAAELKAAAIITATQSGITARMVSKFRPTCPIIAVTPHDDVARRLALNFGITPITSEKVVSTDELISVSIKRALNENLIKKGDLVVVVAGVPVGESGTTNMLKIQYT

SEQ ID NO: 11488 - protein, 474 aa, Clostridium acetobutylicum ATCC 824
MLSEFPKNFLWGASSAAYQVEGAWKEDGKGESVWDNFSKIPGKTFEGTNGDVAVDHYHRFKEDVALMAEMGLKAYRFSVSWSRIYPKGRGKVNLKGLEFYKNLVDELLKYNIEPVLTLYHWDLPQALQDLYGGFESRNVISDFENYCITLFKNFKDKVKYWITFNEQNVFTNLGYRCAVHPPGIKDIKKYYLANHIVNLANASAIKAFRKYVPNGKIGPSFGMGPVYSFDCKPENVLAGDEAEEYFNHWWLDVYCFGKYPTITLNRLEKLKVMPEITKEDLQLLREAKPDFIGLNYYHGGTVMANDNVIRENLDKKDPYLVENSEEDKGFKYISNPFLKKTEWNWEIDPQGLRIALRRLTNRYNLPILITENGIGAVDRLEEDERINDDYRIEYLKAHVLACKEAIDDGVQLIGYLPWSFTDLLSWLNGYKKRYGFVYINRDEHSQKDLRRIKKKSFYWYKDVIEKNSDNIYGR

SEQ ID NO: 11489 - protein, 233 aa, Clostridium acetobutylicum ATCC 824
MTIFFAELVGTLLLILLGDGVVANVVLKNSKGHASGWIVITMGWAFAVAIPALIFGSYSNQFNPALTIALAVIGKVAWAKVPIYLAGQFIGAFLGAVLVFVVYYDQFKCSENKTDKLGVFCTVPAVRNSLINFLCEVIGTFVLVFGILGVGAQNLKNGMGAVFVGFLILVIGLSLGGPTGYAINPARDLAPRIAHLVLPIPNKGDSNWSYAWIPIIAPVVGGIIGAVCYMLLL

SEQ ID NO: 11490 - protein, 417 aa, Clostridium acetobutylicum ATCC 824
MNYELIVVGGGPAGLAAAYEAYNNGIKNILILERDKELGGILNQCIHNGFGLHTFKEELTGPEYADRFIEMVKDTNVEVKLNTMVLEITKDKKVYAINSKEGYMELEAKAIILSMGCRERTRGAINIPGDRPAGVFTAGAAQRYINVEGYMPGKEVVILGSGDIGLIMARRMTLEGAKVKAVVELCPYSNGLNRNIVQCLNDYNIPLYLSHTVTDIIGKERLEKVIIAKVDENRRPIKGTEIEFDADTLLLSVGLIPENELSSNAGIELDRRTNGLRVTESMETSIDGIFACGNVVHVHDLVDFVTEESKRTGASAAKYIKGELKKDKYVNIVNGTNVNYTVPQKLNVDDVEDRLTIFMRVNNIYHNKVLVVRSKEEVIAKFKRAHLAPSEMEKVVLGKAFLDKIKSDITISLEDGE

SEQ ID NO: 11491 - protein, 469 aa, Clostridium acetobutylicum ATCC 824
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 11492 - protein, 455 aa, Clostridium acetobutylicum ATCC 824
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 11493 - protein, 447 aa, Clostridium acetobutylicum ATCC 824
MKDIERDDLKYIWHPCTQMKDYEKMPPIVIDKGEGCYLYDVNGNSYLDCISSWWTNIFGHSNKRINKAIEKQLNEIEHVIFAHFSNKPAVEFSKSLIQIAPEGLDKIFFSDNGSSAVEIALKMSFQYYQQTGKVKKTKFAALTNAYHGETIGALSVGDLDLYSKIYKPLLIDTLRIQGPDCYRCKYNKERHSCEAECFEEMEKSLKKHNSELCAIIIEPMIQGAAGMKMYSPKYLKKLRYACDYYDISVIFDEIAVGFGRTGKMFACENADISPDIMCLSKGISAGYMPMSVVLTTSKIYNAFYDDYVNLKAFIHSHTYAGNALACAAAIESLKIFKEESIIEKNIGKSKLIEKLTKNRARNNKFIGDIRSLGMVTAIELVKDKDTKESFDWKSRVGYEIYKIALKKGLLLRPIGDVLYFMPPYSIGEKDIEFMVEKCFESIEQYLE

SEQ ID NO: 11494 - protein, 499 aa, Clostridium acetobutylicum ATCC 824
MIKRALISVFNKNGILKLAKFLNEKGVEILSTGGTYKHLKENGIPVIEVSEVTGFDEILDGRVKTLHPKIHGGILAIRDNKEHMDTIKNKGITPIDMVVVNLYPFFDKVKENISFEEKVEFIDIGGPTMIRAAAKNFQDVVVLTDVNDYDDVIDQIEKTGEVAYNTKKRLAGKVFNLMSAYDGAISRFLLEDEYPEYLAVPYKKKMDLRYGENPHQTAAFYEAAFGDGAMKGFEQLNGKELSYNNIKDMDIAWKVVNEFDETVCCALKHNSPCGVAIGENPLDAYKKAFECDDTSIFGGIVALNKVIDKPAAEEMVKIFLEIVIAPDFTADALEVLKSKKNLRVIKANEKPSDNFELAKVDGAMLVQSADNKLTEKMEVVTDKKPTDEEMRDMIFGMKVVKYVKSNAIVVVKNGAAVGIGGGQVNRIWPAKDAMERGKGAAVLASDAFFPFGDIVEEAHKNGIKAIIQPGGSIRDQESIDGCNKYGISMVMTGIRHFKH

SEQ ID NO: 11495 - protein, 473 aa, Clostridium acetobutylicum ATCC 824
MKMKDGFLWGGATAANQFEGAWNEDGKGPSTADMMTGGTHTTPRRITPVLEEGTYYPSHEAIDFYHHYKEDIKLFAEMGFKTFRLSIAWSRIFPNGDDKEPNEAGLQFYDNVFDELLKYNIEPLVTISHYETPFGLTEKYNGWVGREVIDFYTRYCETIFNRYKDKVKYWLTFNEINCLTIPQFGAYMGGGIIPKEGDSEAQLRFQALHHQFVASAKAVKLGHEINPNFKIGCMIAYMCNYAKTCNPDDVLETQRKDQIHNMLCSDVQVRGYYPGFALNYFKENGIEIKMEKDDEKILREGCVDFYSFSYYMSNLVSTDKNDKEVSGNLLGGYKNPYLKSSDWGWQIDPKGLRWTLNHIYDRYQIPVMVVENGLGAVDVIEEDGSINDDYRIDYLRDHIVEMEEAVKNGVDLMGYTMWGCIDLVSASTGEMKKRYGFIYVDKDNDGNGTMARKPKKSFNWYKKVIASNGENLE

SEQ ID NO: 11496 - protein, 477 aa, Clostridium acetobutylicum ATCC 824
MSKGFSKEFLWGGATAANQCEGAYLEDNKGLSTVDVIPKGKDRFPVGLGKMKMLECDSEHYYPSHEAIDFYHRYKEDIALFHEMGFKCFRLSLAWSRIFPNGDDEIPNEEGLKFYDAVFDECLKYGIEPLVTITHFDVPVNLVKTVGSWRSSKMVEYYEKLCKVIFSRYKNKVKYWLTFNEINMLLHLPFIGAGLVFEEGENEEAIKYQAAHHQLIASAKATKIAREINPNFKIGCMLAAGNNYANTCAPEDVWRSIEKDRENYFFIDVQSRGEYPNYAKKMLKRKGIELQVEDEDAGILKNNTVDFISFSYYSSRLTSANPNINGNTEGNVFATLKNPYLKASEWGWQIDPLGLRITLNSLYDRYQKPLFIVENGLGAVDTPDENGYVEDDYRIEYLREHIKAMRDAVNVDGVELMGYTPWGCIDLVSASTGEMKKRYGFIYVDKDNDGNGTLKRSKKKSFYWYKKVIESNGMDIE

SEQ ID NO: 11497 - protein, 445 aa, Clostridium acetobutylicum ATCC 824
MEEINAKVVTKVPGPKSRELLKKREKYVAKGVSCSYPVFVEEAKGALVKDIDGNVFVDFAGGIGVQNIGHRDDGVVEAVKEQLDKYIHACFHVNMYEPYVDLAEKLTEITPGNFAKKAMFANSGAEAVENAIKIARAYTKKSGIISMNGSFHGRTNMTMSITSKYKPYKNGFGPFVCETYKADYAYCYRCPLGCKFKDCGIACAEKLKTMLKTVVSPDMIACLIVEPVQGEGGFVVPPKDYFKALQQICNENNIVFIVDEVQAGFARTGKFFAHEYFDVDADIITMSKSIANGLPISAVVGKAEIMDAACVGGIGGTYGGNPLSCVAAIKVIDKIKEANLNEKSIELGKSIMNRLNEMKEKYNVIGDVRGLGAMIGVEFVKDKDTKEPNKEIVSSILDYCFKHGVIFLNAGLLGNVLRFLPPVVMTDEQLKYGLDTLEEAIRIAI

SEQ ID NO: 11498 - protein, 455 aa, Clostridium acetobutylicum ATCC 824
MDQTKSKNQNLSRGLKNRHVQLLAIGGAIGTGLFLGSGRSIHLAGPSILFAYMITGAICFLVMRALGELLVSNLNYHSFVDFVQDYLGNGAAFITGWTYWFCWISLAMADVTATGLYVQYWIPSLPRWVPSLVILLILLIMNLTAVRLFGEMEFWFALIKVVAILALIIVGIFMIIKGFSTSAGAASFTNLWKHGGWFPNGSNGFILSFQMVVFAFTGIELVGLTAGETEDPEHVIPKAINNIPVRIIIFYIGALAVIMSIYPWNSINPDKSPFVQVFAAVGVAAAATIVNFVVLTSAASACNSGIFSTSRMVFSLANENNAPESMKKLTSHKIPSNATIFSAAVILIAVILNYIMPEGVFVLITSISTFCFIFIWAIIVICHIKYRKANPELASKNNFKMPLYPIANYIILAFFAFVIVTLALNSETRVALFVTPVWFIVLGIIYFISKSKKKN

SEQ ID NO: 11499 - protein, 181 aa, Clostridium acetobutylicum ATCC 824
MSVYDFKAKTIEGKEVSLDTYKGKVLIIANTASKCGFTPQYEGLEKLYKEYKDKGLEILGFPSNQFAEQEPGDNNEVKNFCKLNYGVTFQLFEKTDVRDENAHPLFNYLTENAPFKGFDLNHPTGKMLSEVLEKNFPKFLEGNSVKWNFTKFLIDRDGNVVKRFEPTSEPSDMVKDIEKLL

SEQ ID NO: 11500 - protein, 159 aa, Clostridium acetobutylicum ATCC 824
MSVYDFKAKDISGEEISLSKYEGKVLLIVNTASKCGFTPQYKELEDIYKKLGNEKFEILGFPCNQFANQEPGGSGDIKNFCEINYGVTFPLFEKIDVKGENAHPLFKYLASQAGGILGKEIKWNFTKFLIDKKGDVVDRFAPVTKPSKIKDKIVKLMEE

SEQ ID NO: 11501 - protein, 181 aa, Clostridium acetobutylicum ATCC 824
MSIYDFKVKDINGEDISMEEYRGKALLIVNTASKCGFTPQYEDLEALYKKFKGENFEVLGFPCNQFENQEPGTNNDIKKFCQINYGVTFKIFDKVDVNGENEAPLYRYLKEQAPFKELDESTPTAKIIAAFLREKLPETLIGDSIKWNFTKFLIDKNGRVVNRFESGVEPMEIESYIKALI

SEQ ID NO: 11502 - protein, 479 aa, Clostridium acetobutylicum ATCC 824
MGKVTGFKEYDREESPSRPIDERIKDYKDVHMGLDKEKLKIQGARCMECGTPFCSWGCPLGNLMPDFNDMVYKGEWKKAYERISLTSCFPEFTGRICPALCEGSCTLSYNSDAVSIKEIELGIIEEAFKNGWVKPKIPKVRTGKRIAVIGSGPAGLSAAEELNSVGHSVVVFERADKVGGLLRYGIPDFKLEKHVIDRRIDVMEKSGIEFKTSTNVGFDVSAEELLNDFDVVLLTGGSTIPRDLKVEGRENIKGVHFAVDYLKQQNMRNAGMEIKEEEITAKDKVVVVIGGGDTGSDCIGTAIRQGAKKVYQYEIMDKPPAQRDETMPWPLFPRVFKTTTSHEEGCERLFGVSTKKLEGKDGKLELLKGVQVKWEKDENGKMSMKEIEGSEFEKKVDLILIAMGFVHPQHKGIVEDLQLKLDSRGNVFTDENFMTSRENVFAAGDMRRGQSLVVWAMHEGRQSAKEIDKYLMGETSLRG

SEQ ID NO: 11503 - protein, 384 aa, Clostridium acetobutylicum ATCC 824
MIKINNRLKSIDEYHFKKIEDKKRELIKKGKQIIDLGIGDPDLEVSNRVQNEIIKSLGIKDFNKYPPYSGIEKLKSRVIKYYRDIFQVNLDLDEIIITIGSKEGISSIIPSICDIGDYVIVPNPGYQVYTAASYLWGAVPYKIPLTDKNDYLPNLNVIPQNIALKSKLFFINYPNNPTGAEANKDFFKDIVEFCKKRNIVLVNDSAYNEIIKKESTPISLLQSDEDKKMIEIGSFSKTYNMTGFRVGYVVGNKGVIKALLKVKSNIDSGQFMPVQYAAAEAINLDRNEIKKSREIYDKRRSTAKKILSKKGIKYFDASAAFYIWCSVPKGYSTDEFCDKLLSEYGVVVTPGYCFGNLGYGFFRIALTTKIENIETALSKFEDFQ

SEQ ID NO: 11504 - protein, 216 aa, Clostridium acetobutylicum ATCC 824
MIKLAASILSADFSKLGEEVRTLDEAGADFIHIDIMDGNFVPNISFGIPVVRDIRKHTKLTFDVHLMIEEPSKYVEQFVKSGADIITVHYETDRHIDRTLNYIKSFGVKAAVAINPGTPVNMIKNLLTTADMVLIMSVNPGFGGQKYIDYSYDKIREVKKYADEIGRDILIEVDGGVDSTNIKKVVEAGANVVVAGSAVFKNGDIKKNIELLKGSI

SEQ ID NO: 11505 - protein, 489 aa, Clostridium acetobutylicum ATCC 824
MNKIKKFNVKDDRNLSMLMDFYELTMANGYLLKGFGDKIVYFDVFYRKNPDGAGFAIAAGLQQIIDYIKNLKFSEEDIEYLKEKNMFSEDFLKYMKNFRFSGSINAIPEGTPVFPNEALITVKAKAIEAQLIETMLLITINHECLIATKTNRIVRAAKGRPVLEFGARRAQGYDGAVYGARASYIGGAAGTATTLSEQMFNVPASGTMAHSWIQFFGDEFEAFKAYAEIYPDACTLLVDTYNVLESGIPNAIKVAKEVLEPMGKRLKGIRLDSGDLAYLSKKVRKILNASGLEDCKIVVSNSLDEYIIEDLIAQGAKIDVFGVGERMITAKSDPVFGGVYKLVAVEEDGQIVPRIKLSENAEKITNPGYKTPWRLYDKETGKAIADVITLAHEKIDENKEYTIFDQENIWKKKKITKFVARKLQVPVFIDGECVYESPTLEESREYCEKQLDTLWDEVKRFVNPHKYYVDLSMELWHVKQELIQKYRVK

SEQ ID NO: 11506 - protein, 224 aa, Clostridium acetobutylicum ATCC 824
MKTAIEVTNLYKTFKNDKIETTILKNIQVTINEGEFVSIMGPSGSGKSTLLYLIGGLDKPTSGSIKIKGKDIAVMSDNEASNMRCRNVGFVFQFYNLIPNLSVEENILLPILLEGKSEKLYKEKLDEILEDIGLSTKRKYTPKQLSGGQQQRVAIARALINEPDIILADEPIGNLDSKTGNEIMELLRKINREKGKTIVQVTHSQESSTYGNRTIFLKDGMIQN

SEQ ID NO: 11507 - protein, 309 aa, Clostridium acetobutylicum ATCC 824
MGKIYKNLIETIGRTPLVELSNYKEKNKIEGNILGKVEYFNPSGSIKDRIAYSMIKNAEEQGLINKDTVIIEPTSGNTGVGLAFIAAAKGYKLILTMPETMSVERRKLLTAYGAEIVLTSGVEGMTGAIKKANELASENPNSFIPQQFKNPSNPAIHEVTTGIEIWEDTDGKVDAVVAGVGTGGTITGIAKTLREKNKDIKIIAVEPATSPVLSGGKAGPHKIQGIGAGFVPDVYEAELIDEIIQVKNEDAFASAKELAREEGILAGISSGAALFAAKEVASRPEFKGKNVVVILPDSGQRYLSMSVFD

SEQ ID NO: 11508 - protein, 387 aa, Clostridium acetobutylicum ATCC 824
MSKSYLMNTYGRFNVTFDKGEGTKLYDKDGNEYIDFVSGVAVNCLGHCNPSIVKAIEEQSSKLMHVSNYYWNENAMELTEILCKNSEFDKVFMCNSGTEAIEAGLKLARKYALLHGDENKKEIIYMDNSFHGRTMGALSVTGQPKYQESFKPLIGAVKSVKFNDLDDIKQKISSKTAAVIVEPIQGEGGIIPAKKEYLKLLRDLCDENNALLIFDEVQCGMGRVGSLFAYQKFEVVPDIVCIAKALGGGFPIGAMLAKESVASSFVPGDHGNTYGGNPLACAVAIAVLKELVDKKVVEINVNEKSKYLFDKLMTLKEKYKVINDVRGMGLLIGVEVACDVKKIINKCFESKLLLITAGKNVVRFLPPLNVSFEEIDKALGIFEESIK

SEQ ID NO: 11509 - protein, 286 aa, Clostridium acetobutylicum ATCC 824
MLDLWYSESHADDTKFSIRVKEHLYSEKTPFQQIDFFKSETFGTFFTLDGYIMMTEKDEFIYHEMITHVPMAVNPKIKKVLIVGGGDGGTSREILRYNTIEKVDMVEIDERVVRLCQKYLTQTSCKLDNDSRLTMHFEDGKEFVKRAETGFYDLILVDSTDPIGPGEGLFTNEFYRDCERILSDDGILINQHESPYYKDYCHEMKRAHSKIKDKFPISMVYQFHMPTYASGHWLFGFASKKYHPLNNLNADSWNSLGLKTKYYNTNLHKGAFALPNYVIDELEKTE

SEQ ID NO: 11510 - protein, 450 aa, Clostridium acetobutylicum ATCC 824
MSECFKLELKNTKPYLQDEELKNLKPAVAAAHEAIHNGTGAGNDFLGWVDLPVNYDKDEFERIKKSAEKIRNSVDAFIVIGIGGSYLGARAAIEMFSHSFSSSISKEERKNPEIFFCGNNISSTYLADLLEAIEGKDIAVNVISKSGTTTEPAIAFRIFKELLEKKYGKEEAKNRIFATTDAKKGALKTLSDNEGYETFVVPDDVGGRYSVLTAVGLLPIAVAGIDIDEMMKGAAKAREVYSEPDLEKNEAYQYAAARNALYSKGKSIEMVVNFEPSLHYFGEWWKQLFGESEGKDGKGLFPAAGDFSTDLHSMGQYIQEGRRQLIETFINVVNPKKEVTIQKDAENLDGLNFVAGKTMDFVNKQAFMGTVLAHHDGGVPVMVVNVPELTAYYFGYMVYFFEKACGISGYLLGVNPFNQPGVEAYKKNMFALLGKPGYEDLAKELNNKLK

SEQ ID NO: 11511 - protein, 451 aa, Clostridium acetobutylicum ATCC 824
MPWFKKAIFYHIYPLGLCGAPLSNDFTSKPIPRLKEIENWIPYLKSLGITALYLGPVFESTSHGYDTADYYTVDRRLGTNDTLKKLINKLHKNGIKVVLDGVFNHVGRNFPQFMDLIINKQTSSFATWFSGVDFNSKSPYNDDFSYDTWNGCYDLVKLNFNNNEVKSFILNAINFWISEFKIDGIRLDAADCIDINFLREISNFSKSISDDFFLLGEIIFGDYTRFASKNILDSVTNYECYKGLYSSHNSLNYFEIAYSLNRQFGDGGIYKNIPLYNFVDNHDVNRIASTLIDAANIYPIYTILFTIPGIPSIYYGSDFGITGVKQNNSDKYLRPRLKINELKNSKENKPLNNFIKKLCHIRINSEALTEGLYKQLFISNKLFAFLRYTDSEKIIVALNCSKECSQIEFSNDMNATSLFDLIEKKSLKLEPNGTISITLQENQARIFKVSF

SEQ ID NO: 11512 - protein, 485 aa, Clostridium acetobutylicum ATCC 824
MAKILKQAYTFDDVLLVPNKSEVLPKEVDLSTNLTKKIKLNIPLMSAGMDTVTESKMAIAMAREGGIGIIHKNMTIAEQASEVDRVKRQENGVITNPISLSKDNSVQEALDLMKRYRISGVPITDNAGKLIGIITNRDIVFETDYSKKIEELMTTENLVTAPQGTTIDEAKNLLKKHKIEKLPLVDENFVLKGLITIKDIEKIRKFPNAAKDSQGRLLCGAGVGVTKDMMDRVKALVDASVDVIVLDTAHGHSQGVLEAVKTIKKAYPELQVIAGNVATAAAVHDLIEAGADCVKVGIGPGSICTTRVVAGIGVPQLTAVMDCVEEANKYGVPIIADGGIKYSGDIVKALAAGAKAVMMGSMFAGCEEAPGETEIYQGRSYKVYRGMGSLAAMQCGSKDRYFQEGNKKLVPEGVEGRVPFKGSVIETVFQILGGIRSGMGYLGSRNMTELFEKATFVVQTSAGLRESHPHDISITKEAPNYSVNQ

SEQ ID NO: 11513 - protein, 330 aa, Clostridium acetobutylicum ATCC 824
MRKSSKIKRIVLAVVLVIFIFANCVGLYVGNLIYDKVCKMQFDRSQSSYNNFKSTFNYERYNLLNKSDVVIESNFGYKLSGTYIKNFVDSRKTIIIVHGITGSRWESMKYADIYLDLGYNVLIYDSRYHGVSGGNDITLGYFEKYDLNNCVKWVKNKTPGGIIGIHGESMGAATALLQSNMNEKTKDVSFYVVDCPFSDLPQLFGEKLNYEMKNHGAVVAKMVVFYSSLIAFFKAGFSVYAISPIKAIQDVKTPIMFAHGADDDLIPPEMSVDLYSIKKGAKYLYIAPNAGHAEAYLKNKTDYTNKVRQFLIDIHVEDNKTDINKPVRMY

SEQ ID NO: 11514 - protein, 243 aa, Clostridium acetobutylicum ATCC 824
MRKLVLLRHGQSEWNKENRFTGWTDVDLSVDGVSEAAQAGRILKKNNYTFDAAYTSVLKRAIRTLQIVLYEMDLLWIPVYKSWKLNERHYGALQGLNKDETRDKYGEDQVHLWRRSVEVRPPALEKSDKRYPGNEKKYASLKEEELPVTENLEDTEKRVLQDWRELIAPNIKGGKNIIISAHGNTLRALVKYLDNIPSDGIANLNIPTGTPLVYELDENLEPITRYYLGMDGKIEDDKFPKKV

SEQ ID NO: 11515 - protein, 317 aa, Clostridium acetobutylicum ATCC 824
MKIFRKKSLDKMMVSAEKTHLKKTLKTKDIAALGIGAVVGVGIFVATGTGAHKAGPGIIISFLLAGIVACLCGLCYSELATMFPVSGSTYSYAYITFGEIVAMIVGWCLTSEYLVACSAVASGWSGTFIGILKNAGIVLPKVITASPSKGGIVDLPAVLITLILTYILYYGMKESSRVNNIIVIVKIAIIVMFLVLGATHIKMTNYKPFAPFGFKGIFAGASVIFFSYIGFDAISTTAEEAENPGRDVSRGLIICLAVVSILYISVAFVLTGMVHYDKIVTEDAVPAALASVGIRWGSALVGIGAILGMISTMIAVL

SEQ ID NO: 11516 - protein, 429 aa, Clostridium acetobutylicum ATCC 824
MLDKIFHLSENKTNVKTELLAGFTTFMTMAYILIVNPSILSKTGMPVAAVFTATALASFVGTIIMAFVANYPFGMAPGMGLNALFTYTICIQLHFSWKTALAASLIEGIIFLVLNVFKIRQLILDSVPQTLKYAISIGIGFFITFIGLQDAGIIVGSKGTLVTLASLKSPAVLLAVIGVLLIAVLYNKNIKGSFVIGMLVIYVLGIIFGVAKAPSGIVSFPPSVAPVFLQFDFKSAAVIGIVPVILTMLFIDIFDSIGTLIGLSSKAGLLDEEGNVQNADKVLTADAVGSALGACLGTSTPVAFVESASGIAEGGRTGLTGVTIAALFLLSLFFSPILTAIPSFATGPVLIVLGAVMMEPITKVDFSDFTEGFPVFITLILILLTYSITDGLAFGFLSYVVIKVFGGKAKEIPPALYVIAILFVGMFAL

SEQ ID NO: 11517 - protein, 395 aa, Clostridium acetobutylicum ATCC 824
MRKVFEESKIGNIKLKNRILRSATHESMADSEGKPTEDLIKKYMELAQGEVGAIITGYTGVMQNGKSPAKNMLMLDKDENITSFKNMVNEIHKYDVPIILQIAHCGRQTSEKVTGKPTVAPSPIRDKIYRGSVPHELTDVAINEIIEAFVNAIERAIKAGFDGVELHLAHGYLLSSFLSPHMNKRKDKWGGSTENRFRIVSEIMKRARQKFKNYPILAKINGYEASKDGIKLEEAIKISKALENSGINAIEVSCGIAEEGFVTIRGKVPFDMILKCDPTMKRIPEFLKPIVKHVGKLIVKSPEPHFLYNLNNAREIKNKVTIPVIVVGGIRKFSDIEDIIAKDCDFVSMSRPFIIQPSIVKTFKEGKEKESRCINCNYCLIGVETNELKCYYGKI

SEQ ID NO: 11518 - protein, 429 aa, Clostridium acetobutylicum ATCC 824
MLERIFKLKDRNTNVKTEIIAGLTTFMTMSYILMVQPSLMKSAGMNAGAVVVVTALLSAVCTLLMSFYTNLPFALAPAMGSNAFFAITLVKGGVVTWQEGLGMIFLSGVIFLLLTVLGLREVIVKIIPKNIKLSIGVAIGFYIVLIGFGDGNIMSIVDGSIKMGSLKSPATLLSLIGLAITIAFMANKIKGAALWSILITTLIGIPMGITKVPASLISMPPSIAPIAFKLNILSVLKLSFFPIIFTFFIGDFFSALGTILGVSSKAGLLDKDGNLENIQRPFLVDSISAILASLFGSTLITAYIESAAGVEEGGRTGLTGVITALCFLLTLFLTPIATMIPSSATAPVLIAIGLSMISGIKDIDFSDFTEAFPAFATIVFTAFTSSISNGISIGIIAYAFGKLVCGKVKELHWGIYVLCIPLVLYFVFM

SEQ ID NO: 11519 - protein, 377 aa, Clostridium acetobutylicum ATCC 824
MIELKNIYKKVNNRIILNNVNLTINKGELVTLIGPSGCGKTTTLKMINRLIRQTSGEILINGNKIQNEDAIKLRRNIGYVIQQTGLFPHLTVEENISMILKIEKVDQTKIDKKVEELLNLVGMNPEDYKYKYPSQLSGGQQQRIGIARALAMDPEIILMDEPFSALDPLTRNQLQDEIFSIHQNLKKTIVFVTHDMDEALKLADKICIMKDGKVIQYDTPDKILKNPKDDFVKTFVGENRIWNQPELIKVKDIMINNVIKSSPERTSIQALEIMKSNHVDRLIVASKDNKLLGIVTLRELKFSINENKKLKDIMKNNITTINENDSIVNVLDIVENQKIGFIPVINNDSSLVGLITKSSLLSVLSNQFINKEVNLYE

SEQ ID NO: 11520 - protein, 324 aa, Clostridium acetobutylicum ATCC 824
MKIVVLDGYTLNPGDMSWEAFKEIGDLTVYDRTDYTGKEEEKTIERARDAEAILTNKTIITSKVIEKLPKLKYIGVLATGYNVVDLEFAKKKGIVVTNIPQYSTSSVVQMSMALILEICGHVGQHNASVKKGDWQNCADFSYLKYPIIELSGKTIGLVGYGSIGKAMQKAAEALGMKVFVYTPHPDKKYENESMKFVSLDTLFKEADVISLHCPLKDDNKEMINKASIKKMKNGVIIINTARGGLINERDLYEALKENKVYAAALDVVSFEPIKEDNPLLKAENCIITPHIAWATSEARQRLMNIAVNNLKQFVDGCPINVVNK

SEQ ID NO: 11521 - protein, 474 aa, Clostridium acetobutylicum ATCC 824
MNNFGEDFIFGGATAAYQAEGATKEDGKGPCIWDEYLKKEGRFTGDTASDFYHKYKEDLKFSRKFGVNGIRISIAWSRVIPDGKGEVNPKGLKFYSDLIDECIKNNVEPFVTLHHFDTPLTLFKDGDWLNRNNIDYFVRFAKVCFEALGDRVKKWITFNEAWAVAQNGYIIGNFPPSIKYDIPKAAQSMHNMMVAHAKVVELYKSMNLDGEIGIVHTLEGKYPITDSKEDKEAAYLDYMISNKFMLDACFKGEYPKETEKTINEIMSKNGGELKIYDGDLEVLKKASSKIDFLGMNYYSSHFLKAYEGESRIHHNGTGEKGTSIFALKGIGERVNNPEVPTTDWDWPIYPKGLHDMLVRIKNEYPNYKKIYVTENGMGYKDDFKDGKIDDTPRIDYINKHLEAILKAKNEGVVVKGYFVWSLMDVLSWSNGYNKRYGLFYVDFKTQNRYAKKSAYWFKRISYEKKLIDFSDIEY

SEQ ID NO: 11522 - protein, 356 aa, Clostridium acetobutylicum ATCC 824
MLYALVLAGGKGTRLYPLSRKESPKQFLKFIHNKSFLRNTVDRIKTLVDKENIYIVTNERYINKIQEELPEINRSNIFTEPENKETATCIGLSAVKLLKKDSDATMIVLPSDHYIENEKEFIDTLRQGVEVVERKRCLVTMGITPTRPETGYGYIQMGDKVINYESIYKVERFLEKPNIEVAKDLLSKGNYLWNSGMFVWRADTYLREMNKYLPKMYKAMMEIYENVGTKTEEETINEKYKIIDGISVDFGIMQKTRKAYVVKANFEWDDLGNFSSLARFLKSYEGGNTISDNVFLEDTENCSIFGSENLIICFGVKDLIVVDAGNVVLIMDKNRDQELKHLVEELKNKKEIEDYL

SEQ ID NO: 11523 - protein, 350 aa, Clostridium acetobutylicum ATCC 824
MLCALIMAGGKGERFWPLSTDEKPKQFLQLLSDKTMIQMTVERLEDLIDIERIFVVTGERYVDLLKEQLPNLPEKNIIVEPVGKNTAPCIALSAFVINKHYKDANIVVLPSDQLIVDDSKLLDTIAAAEKFIDQNKASIVTLGMEPTRAETGYGYIKSGNLEKEISGFQIKKVESFVEKPDKKSAESYVEAGNFLWNGGMFIWKCSTILKLTEKYLNKTYNILNEIAEANDTNFNETLKKKYVDVEAISVDYGIMEKADNIYVIPCSFGWDDIGTWHAVERYRDKDEDNNVCVGDIKSIDSKNNILVGKKKPIVVVGLSEVFVVESDDIIFVGKKEDIERIKEIKKKVKE

SEQ ID NO: 11524 - protein, 350 aa, Clostridium acetobutylicum ATCC 824
MLCALIMAGGKGERFWPLSTDEKPKQFLKLLSDKTMIQMTVERLESLIDIEKIFVVTGERYVDILREQLPRLPKRNIIVEPVGRNTAPCIALSAFVINKYYKDASIVVLPSDHLIVNEDKLLDAIRSAEEFIEKNDNSIVTLGMEPTRAETGYGYIKSGEVKEEISGFKIKKVDEFVEKPNKEKAEEYVKAGNFLWNGGMFIWKCSTIFKLTEKYLNKTYNILRSISEANGDEFNVLLKREYVKVDNISVDYGIMEKADSIYVIPCDFGWDDIGTWHAVERYRDKDEDNNVCVGDIKSIDSKNNILVGKKKPIVVVGLSDVFVVESDDIIFVGKKDDIERIKEIKKKVIK

SEQ ID NO: 11525 - protein, 215 aa, Clostridium acetobutylicum ATCC 824
MKIILLGPPGAGKGTQAKLISSEFSIPHISTGDIFRANISGKTELGMKAKGYMDKGLLVPDELTIDIVKDRISKDDCKSGFLLDGFPRTVNQAEALDKFLVGRKEKIDCALLIDVPREKIFNRMTGRRVCSKCGASYHIEYNPTKVEGICDLCGSPVVQRKDDSEDTVKERLDVYDRQTEPLVVYYRNEAVLKSVDGTQDIDKVFEDIRNVLGEI

SEQ ID NO: 11526 - protein, 263 aa, Clostridium acetobutylicum ATCC 824
MANKIDLKFKELKYKNKKAMIPFVTSGYPDVETTKKIVIEMEKSGADLIELGIPYSDPVADGPIIQISSSGALNNGLKIKDIMNMVKEVRKNVKIPIVYMGYFGCVFKYGLEKFIKDSKESGVDGIVIPDLPLEERERVKEIADRYEFYIIPLVAPTSEDRIGKIVNGAKGFIYCVSTNGVTGVRNIIANDVKAYIDVVSKASNVPKCIGFGISSPEMAQKMKEYCDGVIIGSAVMKIVEEDIPKEEMIRKVGEFISQVNEVL

SEQ ID NO: 11527 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 11528 - protein, 450 aa, Clostridium acetobutylicum ATCC 824
MSKVKSFFVCQECGYQSVKWLGKCPSCNSWNSFVEEERVENKKASKITLNSEPKCINNIKSGQYERYDTNNTELNRVLGGGLVKGSITLISGAPGIGKSTLLLQICQDIALKYGKVLYVSGEESEHQIKMRGDRLGVTSANIYILAETNMESIERHVENIKPAFVIIDSIQTLYKDQITSAPGSVSQVRECANDIMRIAKTDNIPFFIVAHVTKQGELAGPRVLEHIVDTVLTFEGQRTEEFRILRTVKNRFGTTSEIGVFEMKEEGLEQIHNPSSLFLEETNFNQEGSVVIGIMEGTRPILVEIQALVSKTNAVMPRRTSVGIDSSRLNLILAVLEKKLKVPFYNCDVYVNVVGGLNIEGTYGDLGLALALVSSVKGVSIKLDKMIVVGEIGLTGEVRPVSFSDRIVNEADKLGFKNILMPQKNIKNDKNIAINIIGVSYLKEAVNKVF

SEQ ID NO: 11529 - protein, 178 aa, Clostridium acetobutylicum ATCC 824
MREDIKEVLLDEEKINEKVKELGKKISEDYKGKDLILIGILKGSVVFMGNLVKYIDIPCAIDFMSVSSYGNGTSTSGIVKVLKDLDSDVEGKDILIVEDIIDSGVTLKYLMGHISGKKPNSIEIITLLNKPERRRVEINVKYTGFIVPDYFLVGYGLDYAEKYRNLPYIGILKDEIYE

SEQ ID NO: 11530 - protein, 339 aa, Clostridium acetobutylicum ATCC 824
MKIFEAYTIKNMCLKNRIVMPPMCMYSSDNTGNINDFHLVHYTTRSIGGVGFIIVEATGITPNGRISDKDLGIWSEKHAEGLSFLVKEVKKYGSKIAIQLNHSGRKYEGTSGEPVAPSALAFDENSKTPKELTKNEIKEIILAFKAAAKRAEKAGFDAIEIHGAHGYLINQFLSPLSNFRDDEYGGSTENRTRFLKEVLEAVREVWPKEKPILLRVSAEDYRGGSGITPNEMVNIINIVKDLIDVVDVSSGGVAPAHINLYPGYQVKLSEVIKNECNVPTIAVGLICDINMVEEILSNNRADLVALGRELLRNPYFVLSSARLKNINIDFPKPYERAFN

SEQ ID NO: 11531 - protein, 247 aa, Clostridium acetobutylicum ATCC 824
MITISNLHKSFGNTEILKGIDLNVNKGETTVIIGPSGSGKTTLLRCINLLETPNKGSITVGNSSIDFDNNNSFYTSDVINLRKKTGMVFQSFNLFPHMTVLQNIMEGQVTVLKRSKSEARKKALLLLEKVGLSEKQDQYPHELSGGQQQRVAIARAMAMDPEVLLFDEPTSALDPELEAEVLKVMKELSNEGMTMIVVTHKMSFAKDAAHRVIFMDNGTIIEAGTPEHVFTASTNPRVKQFLNIVSD

SEQ ID NO: 11532 - protein, 292 aa, Clostridium acetobutylicum ATCC 824
MINKNTKIGFIGTGVMGKGMIKNLLKGGYTVHVYNRTKEKALPLVEIGAVLETSIKELSQRCDVIITMVGYPSDVEEVYFNDNGILNNLKPQSYVVDMTTSKPSLAKKIYAAAKERNIFALDAPVSGGDIGAAEGTLSIMVGGDKEAFDALMPIFELMGKNIVLQGSAGSGQHTKMCNQIAIASNIMGVCEALSYAKKSGLNAETVLKSIGAGGAASWQLSAYAPRILKGDFNPGFYIKHFVKDMKIALEEADEMGLKTPALELSKKLYDKLIKEGKEDLGTQALYHLYNED

SEQ ID NO: 11533 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 11534 - protein, 452 aa, Clostridium acetobutylicum ATCC 824
MKSLATDMTEGNVSKHLIKFAIPLILGNLFQLTYNASDSIIVGRFVGKNALAAVGIANPIMNIVMFFIVGICLGASVLMSEYYGAGNVKKLRREISTTVIAGFIFTVLIIIICVIFTEPILGLVKTPKEIIPEAAIYLRIIFISLIFTFFYNIYAAALRSIGDSKNPLLFLMISAVLNVVMDIVFVVWLKMGVAGSAIATSVAEMMSCVFCIVYVHFKIPILKFSFKDMVIDKGLLRSTVNYSWATAMQQTCLYVGKFMVQGAVNPLGVNSIAAFNAVNRVDDFAFAPEQSISNAMTTFLAQNRGANKYKRIKKGFLTGMKLETLYWCILVGIVYLGSTAIMKLFVSGSEVKVISIGSYYLKLMAFFYLLPSWTNGVQGYFRGMGDMKITLRSTFSQIVGRVAFSYILAPRIGMVGIAFSCLGGWIVMLAYEVPCLIKYRRNFNNKLSESSI

SEQ ID NO: 11535 - protein, 306 aa, Clostridium acetobutylicum ATCC 824
MKTLNIGKGELSNVSEISLGCMRLSELTVSDASKLISTALEEGINFFDHADIYGGGRCEEIFSEAIDMKPSVREKLIIQSKCGIRKGFFDFSKEHILNSVDQSLKRLKTEYLDVLLLHRPDALMEPEEVAEAFETLSSSGKVRHFGVSNQNPMQIELLSKYLNNKIIINQLQLSIMHTGMIDAGLNVNMKNEASINCDGSVLDYCRLNDITIQPWSPFQYGFFEGVFLDNDKFPELNKVINNIARDKGVKNTAIAIAWLLRHPAKMQPIVGTTNVNRLKDICKASDIELTRKEWYEIYRAAGNKLP

SEQ ID NO: 11536 - protein, 327 aa, Clostridium acetobutylicum ATCC 824
MESVFDYEDIQLIPAKCIVRSRSECDTSVILGEHSFRLPVVPANMQTIIDENIALFLAQNGYFYIMHRFEPEKRLSFIKNMKSKGLFASISVGVKREEYDFIKQLAQENLSPEYITIDIAHGHSNTVIEMIQHIKKYLPKSFVIAGNVGTPEAVRELEHAGADATKVGIGPGKVCITKIKTGFGTGGWQLAALRWCSKAASKPIIADGGIRTPGDIAKSIRFGATMVMIGSLFAGHEESPGETIEKDGKLYKEYFGSASEFQKGEKRNVEGKKMFVEYKGPLKDTLIEMEQDLQSSISYAGGKSLDAIRTVDYVIVKNSIFNGDRIY

SEQ ID NO: 11537 - protein, 291 aa, Clostridium acetobutylicum ATCC 824
MEKFRTIAITGATSGLGKLVAIELVKRDAHLILTARNKERAEATKKMLESINPKAKIDFFFGDLSVMRDVKRVGEEIKAVHPRIDVLVNNAGLHAFEQRVTSDGLAEMMAVNYLAPWLLTNTLLQSLIASRNARIVNVASEASRNHGELKLPGDLTDISEFTSRESSAIYGKTKLLNIMFTAELARRLSGTGIIVNALNPGFNVTGLGRELWFATALERILKFFHIGDPRKGADIILRLSIDAQYNSVTGGYFNVITGNPISPIYPGGDKVMQNKLWSDTETLLKQRGFIE

SEQ ID NO: 11538 - protein, 342 aa, Clostridium acetobutylicum ATCC 824
MMGKGLVLVTGGSGFIAVHIILKLLNQGYGVRATLRTLSRKDEVKSMLAQGGITDFANLEFIQTDLTSDMNWMEAATGATYVIHVASPTPAIRPDDGDAMVKMAVDGTLRVMKVAKAAGVKRVVLTSASGAVLSGHKSHPDIFTEEDWTNLSGDIDAYQRSKTMAELAAWEFAKKENMEFSVVNPVAVMGPVLGKDFSHSNQIIRSMLTGKMPFLLKIGFDYVDVRDVADLHLLAMIRSEAVGQRFIATTGENLTYKEEAKILQRSLGGAAKKVSIKEMPNFIVKFLAFFMKDLRMPATFLGQNTACSNAKAKKLLGWQPRSAEEAIIATGKSMVELGLVDK

SEQ ID NO: 11539 - protein, 233 aa, Clostridium acetobutylicum ATCC 824
MEELAREEAKSVIEARGLNKIFKLGKMDVEVLKDINIDIKEGEFVSIMGPSGSGKSTLLYLLGGLDKPTSGSVKIAGKELSTMNDKEQSIMRRRDVGFVFQFYNLIPNLNVEENIMLPILLDGKKIKNYRDKLENILKIVGLEERRKHTPRELSGGQQQRVAIARALINEPDVILADEPIGNLDSKTGTEVMELMRKINIEEGKTIVQVTHSSEAAKYGQRIIYVKDGKVVEQ

SEQ ID NO: 11540 - protein, 285 aa, Clostridium acetobutylicum ATCC 824
MGLFKKRKYITVSSKNLDENNDVENQPTIPDGMWIKCSKCGKILYKSDVDDNFKVCPKCNAHLRMNARERIEFIIDEGTFIEFDKNMMAANPLEFPNYEAKIKSMQEKTGLKDGVVTGLGNINGYKTVIAVMDSNFMMGSMGSVVGEKITRAIEEATERKLPVIIFTTSGGARMQEGMFSLMQMAKTSAALAKHNEAGLLYVSVLTDPTTGGVTASFAMLGDIILAEPKTLIGFAGRRVIEQTINQKLPSDFQTSEFLFKHGFIDMIVERKELKVTLGNILRMHS

SEQ ID NO: 11541 - protein, 243 aa, Clostridium acetobutylicum ATCC 824
MLMIEAKNLTKTFGKLTVFEDLNVNISKGEVLVIIGPSGSGKSTFLRCLNHLEEPNGGQVIIEGEVLNHKDKKKYREIIEKTGMVFQSYNLFPHMTVLQNVMEAPITVKKENKSEVRKRAEALLYKVGLSDKMNVYPSKLSGGQKQRVAIARALCMQPDIMLFDEPTSALDPELVGEVLSVMKELAEEGMTMVVVTHEMGFAREVADRVIFMDGGKIVEENTPEGIFTNPKEERTKEFLNKIL

SEQ ID NO: 11542 - protein, 482 aa, Clostridium acetobutylicum ATCC 824
MFENISSNGVYKNLFDGKWVESKTNKTIETHSPYDGSLIGKVQALSKEEVDEIFKSSRTAQKKWGETPINERARIMRKAADILDDNAEYIAKILSNEIAKDLKSSLSEVKRTADFIRFTANEGTHMEGEAINSDNFPGSKKDKLSLVERVPLGIVLAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGPVLPIIRVKSMDEAIELANRSEYGLQSAVFTENMHDAFYIANKLDVGTVQVNNKPERGPDHFPFLGTKSSGMGTQGIRYSIEAMTRHKSIVLNL

SEQ ID NO: 11543 - protein, 297 aa, Burkholderia cepacia
MSVVSFAECSARERIAHLLDAGSFHEWLPPAERATSPHLAQLGLPCAFDDGVAVGRATLDGRPVFVAAQEGAFMGGGVGEVHGAKLVGMFRRALRNRPAAVLLLAESGGVRLHEANAGLIAVSEVMRALLDVRAAGIPVLVLIGGANGCFGGMGIVARCADRIVMSDVGRLAMSGPEVIEASHGVEEFDSRDRALVWRTTGGKHRYLCGDCDALVEDDVQAFRAAAIAWMAAPDASRPLTREALEDEHALLAARLNVLSGAADGGEESFRLWQLLGIREPERVPDLDVEAVRALRAA

SEQ ID NO: 11544 - protein, 1266 aa, Burkholderia cepacia
MQISQKHSTVMDIHSKFDPASRFRGFASGQPAASELRERITAACRTAEPVAVSALLAMAKMEPEVARKANQLSMQIAQRLRERKNSAGRAGIVQGLLQEYALSSQEGVALMCLAEALLRIPDMATRDALIRDKIARGHWQEHAGRSPSLFINAATWGLFLTGKLVSTYSESSLSTLLTRLIAKGGEPLIRKGVDMAMRMMGEQFVTGETIKEALDHARGLEAQGFRYSYDMLGEAAMTAEDADRYRQSYERAIHAIGEASNGRGVYEGPGISIKLSALHPRYSRAQYGRVMDELYPVVRSLALLARRYDIGLNIDAEEADRLELSLDLLEKLCFEPALAGWNGIGLVIQAYQKRCLFVIDHVIELAQRSRHRLMIRLVKGAYWDSEIKRAQVEGQDGFPVYTRKVYTDVSYLACARKLLVAPAEIYPQFATHNAHTMAAIYNLAEPATYQPGQYEFQCLHGMGEPLYEQVVGSLADGKLGRPCRIYAPVGTHETLLAYLVRRLLENGANTSFVNRIADPSIPLEALVEDPVAAVERMAQEEGEAGRPHPCIPSPSALYGQARRNSHGLDLSNEQTLRGLEPILVDSARTGWTAEPLLGESAEAEPTAWKPVLNPADHRDVVGKVRAASEQQIEAALRSATGFAPQWAATSAGDRAFVLERAADLLQDQLPYLLGLLCREAGKSYANGVAEVREAIDFLRFYAAHARTDFDDPAHKPLGPVVCISPWNFPLAIFVGQVSAALAAGNPVLAKPAEQTSLIAAEATRLMHTAGVPRAALQLIPGRGSVVGARMVADARVQGVMFTGSTAVARQLQRTMAERLGPTGAPVPLIAETGGQNAMIVDSSALVEQVVADVMASAFDSAGQRCSALRVLCVQDDVADRLLHMLRGAMAESNVGDPSSLCTDVGPVIDLAARTTIESHIELMQSRGRRVNRAGRAAHEVLEGGTFVLPTMIELESISELEREVFGPVLHVVRYARQDLDTMLAQISATGYGLTMGIHSRIDETIGRVVSSAKVGNVYVNRNMVGAVVGVQPFGGEGLSGTGPKAGGPLYMYRLLAESPHDVLVRAAERGLPGSVADGSVTQASEPFEALLSWIETHRERPLTARCRLLKRTAGSGQMRVLVGPTGERNTYSLQPRVAALCLAEDEDSLLFQLAGALVVGCRAIWPSNTDTQALRATLPLDVQAEIALARDWAAPTVEFDVALYQGSREGLLAASARLAERQGPITSLWRFPTDSGKVPLEALVVEQAVSTNTAAAGGNASLMTIS

SEQ ID NO: 11545 - protein, 463 aa, Burkholderia cepacia
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 11546 - protein, 484 aa, Arabidopsis thaliana
MIPPFKRGRFITKLRSVAGNSRIFSMDAREKSRSFVLVSSRHKRVPVFVMMPIDTFGIDASGCPKIKRLKALTVSLKALKLAGVHGIAVEVWWGIVERFSPLEFKWSLYEELFRLISEAGLKLHVALCFHSNMHLFGGKGGISLPLWIREIGDVNKDIYYRDKSGFSNNDYLTLGVDQLPLFGGRTAVQCYEDFMLSFSTKFEPYLGNVIEEISIGLGPSGELRYPAHPSGDGRWKFPGIGEFQCHDKYMMEDLMAVASQEGKPQWGSRDPPNTGCYNSFPSGVPFFEEGNDSFLSDYGRFFLEWYSGKLICHADAILAKAADVLRRRQEEEKSSVMLVAKIGGIYWWYKTSSHPAELTAGYYNTSLRDGYDPVASVLSRHGAALNIPCLDMADSEIPEKYLCSPEGLRRQIHDVSKKWTIHVTGRNTSERFDEMGLRQIRENCVQPNGDTLRSFTFCRMNEKIFRVENWNNFVPFIRQMSADM

SEQ ID NO: 11547 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGSVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 11548 - protein, 477 aa, Arabidopsis thaliana
MQRFAAKRSVQNISVSLWRRCISSTSQAATASVKDSDEFQARLPPFAYTPPPYTGPSADVILSKRKEFLSPSMFCLYRKPLNIVDGKMQYLFDESGRRYLDAFAGIAVVNCGHCHPDVVEPVINQIKRLQHPTVLYLNHAIADFSEALASKLPGDLKVVFFTNSGTEANELALMMAKLYTGCQDIVAVRNGYHGNAAATMGATGQSMWKFNVVQNSVHHALNPDPYRGVFGSDGEKYAKDLQDLIQYGTTGHIAGFICEAIQGVGGIVELAPGYLSAAYDTVKKAGGLFIADEVQSGFARTGNFWGFEAHNVVPDIVTMAKGIGNGFPLGAVVTTPEIAGVLTRRSYFNTFGGNSVSTTAGLAVLNVIEKEKLQENAAMVGSYLKEKLTQLKEKHEIIGDVRGRGLMLGVELVSDRKLKTPATAETLHIMDQMKELGVLIGKGGYFGNVFRITPPLCFTKGDADFLVEAMDYSMSKM

SEQ ID NO: 11549 - protein, 307 aa, Sorghum bicolor
MSAELKRDYEIGAEIGRGRFGVVHRCTSRATGEAFAVKSVDRSQLADDLDRELAELEPKLAQLAGAGNPGVVQTHAVYEDETWTHTVMDLCAGPDLLEWVRLRRGAPVPEPLAAAIVAQVAQALALCHRRGVAHRDVKPDNILIDTAPAGSDDGEDEEEDSGEAEEAETAPRARLADFGSAAWVGAGGLGRAEGLVGTPHYVAPEVVGGGEYGAKADVWSAGVVMYALLSGGALPFGGETAAEVLAAVLRGSVRFPPRLFSGVSPAAKDLLRRMICRDEWRRFTAEQVLAHPWIVSGGGARAIERPT

SEQ ID NO: 11550 - protein, 472 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 11551 - protein, 290 aa, Solanum berthaultii
LNSSYRVPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEKSDVYSFGVVLFEVLCARPAIVQSLPREMVNLAEWAVDSHNKGQLEQIIDLNLAAKIRPESLRKFGETAVKCLALSSGDRPSMGDVL

SEQ ID NO: 11552 - protein, 292 aa, Solanum demissum
LNSSYRVPFESFRVPFVDLQEATNNFDEKFRIGVGIFGKVYRGVSRDGTKVALKRRNRESPQGIEEFQAEIEILSFCSHPHLVSLIGYCDERNEMILVYEYMENGNLSSHLYGSDLRLPTMSWEQRLEICIGAARGLHYLHNSAVIHRDVKSTNILLDENFVAKITDFGISKTMSELDQTHLSTTVKGSIGYIDPENFIRRQLTEKSDVYSFGVVLFEVLCARPAIVQSLPRETVCLAEWAVDSHNKGQLEQIIDPNLAAKIRPESLRKFGETAVKCLALSSEDRPSMGDVL

SEQ ID NO: 11553 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 11554 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCNHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTFVQGTLGYLDPEYFNRGQLTEKSDVYSFGVVLFEVLCARPAIVQTPSRGMISLAEWVVESQKKGQLEQIIDPNIVAEIRPESLRIFGETAVECLALSGEDRPSMGDVL

SEQ ID NO: 11555 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFGQKLLDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 11556 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 11557 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNVMILVYDYIENGNLRSHLYGPDLPTMSWEQGLEICIGAARGLHYLHTSAVIHRDVKSINILLDENFVAKITDFGISKKGTELDQTHLSTLVQGTIGYLDPEYFLRGQLTEKSDVYSFGVVLFEVLFARPAIVQSLPREMVSLAEWAVDSHNKGQLEQIVDPDLAAKIRPESLRKFGETAVKCLALSSEDRPSMGDVL

SEQ ID NO: 11558 - protein, 204 aa, Solanum vernei
LNSSYRVPFESYRVPFVDLQEATNNFDEKFHIGLGGFGKVYRGVLRDGTKVALKRCKRESSQGIEEFQTEIEILSFCSHPHLISLIGYCDERNEMILVYDYIENGNLRSHLYGLDLPTMSWEQRLEICIGTARGLHYLHSSAVIHRDVKSINILLDENFVAKITDFGLSKKGTELDETHLSTLVQGTIGYLDPEYFIRGQLTEK

SEQ ID NO: 11559 - protein, 198 aa, Solanum vernei
VPFESYRVPFVDLQEATNNFDEKFHIGLGGFGKVYRGVLRDGTKVALKRCKRESSQGIEEFQTEIEILSFCSHPHLISLIGYCDERNEMILVYDYIENGNLRSHLYGLDLPTMSWEQRLEICIGTARGLHYLHSSAVIHRDVKSINILLDENFVAKITDFGLSKKGTELDETHLSTLVQGTIGYLDPEYFIRGQLTEK

SEQ ID NO: 11560 - protein, 355 aa, Claviceps purpurea
MSRANPPNAGGSRKISFNVSEHYDIQDVVGEGAYGVVCSAVHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPPRVLFPKTSDLALDLLEKLLAFNPVKRITVEEALKHPYLEPYHDPDDEPTAPPIPEAFFDFDKHKDNLSKEQLKLLIYEEIMR

SEQ ID NO: 11561 - protein, 397 aa, Rhizobium leguminosarum bv. viciae
  misc_feature (263)..(263): Xaa can be any naturally occurring amino acid
MTMNQSINPHDLGAHAAADDLFTPVDPAAFNAVSPPIFQTSLFTYDSYEAMEDVFAGRTRNYIYSRGDNPTVREFELLVARLEGAEDGRAFSSGTAAITSTILSLVEAGDRVVAVRHLYNDVYRLLVKLLGRLGVAVDFVDPADHDEVRKALSGAKLLYLENPTSFVFELQDIAALSAMAKEAGVTTIIDNSWATPLFQKPIQHGVDIVIHAASKYLGGHSDTVAGVVVGSKEAIARINSISYPYVGAKLSPFEAWLLLRGMXTLRVRLKEHERSGLLLAGRLKEHSAIARVRHPAFQEHPGRATLTGYAGLFAFDLYPDIDVARFVNSLRDIRLGVSWGGTETLVVPAKVALQIPDRMTSFIRFGVSEQTVRFAVGLEEPELLWSDLQQALYAAKR

SEQ ID NO: 11562 - protein, 1333 aa, Rhizobium leguminosarum bv. viciae
MTRMNKQITNFADAHPTDIATDAVFESFPLTIAQKRIWSLEQIGNYTVFPEQVISLRLSPAFDVKTIAGACRTLVAQHPSLATRFRRLAGGRVEQYCGTLNAVPIEIVGEGAALAEPDAWAEQKAFRDRRFDLLAGPPARVQIVLLADGQSLLTIVIHPIISDDREKSILTGSLTRSLDGGPTRDTQLPDILAGTREADWLQTEQAQQSLSYWRQTIGLDYAATTFPTRFNSGGLAGVARAQHRFSIEPGLWEKLDRHVQQKGYQVERVLHAAFCALLARYSGNYALLTGLLIARPQKDHLANRGRAEQILPLTLSLTSRNSLDDVISAITSVTQEGLRRLVPLERITQELVVDEAAAQEAVVKALFEFREPYPIPGHATNLEPLGARADSELSLVIEAGLDGAASGLIDYAQDLYDSAVIARVSRHFILVLEQIVARPNVRIKDIELVGSDELDQLSAPYEDDVVNDDRPVHELISAHSRQTPEKTAIVYGDEEWSHGWLEAGTNRLAHRLRQLGVRAEVTVAIFIKRSPEAIVGILATLKAGGAYIPVEPDHPPARNHHILRDGGVKIVLTHSWLRHRLPEELDATILDLDKIDLDGEPDTPLDIPTHKDQLAYVMYTSGSTGLPKGVAVEHGPLTHHLQNTSRVYGMSSASRELPFLPFSSDGGHERWMNPLMEGGSIILPDQPLWTPEETLTAMRKHGANNASIPTTYLQQLAEWADISDGAPPMRLYSFGGEGLAQPTFDLLSRALKSEWLINGYGPTETIMTPMVWKVRAGTKFQGVYAPLGRAVGLRRVYVLDPDLNPCPIGVTGELYIGGEGIARGYLGKPDTTADRFIPDPFFTEGGRLYRSGDLTRWRDDGTVEFVGRVDHQVKLRGYRIELGEIEAALLQQPGVGEALVVLRDDDAGGEKALVAYVVPKKDETLDVETTRTALERSLPSYMVPAAVVELEKMPTNPNSKLDRFALPAPQPVKRAIVEPATVLEEEVLDVWRQVLKLEAISVEDNFFAIGGNSLGAIRILSLLRQRRPKTPLIVADIFNNPTIRSFAGVMEQGDQRDLSEVIVLRASGAKPRLYCFPGLLVSTREYVKLVDYLGADQPATGFICHSLSEKKAVGAPVEENIESYVDYIGTHSQGAPCYFLGWSWGGLLAYEAARALGDQVDVRMMAMVDVCDLGSEFAIGAKPRFRPGERDELHRDVQAWLGRTAMRPEWDRLLSTMDADTYDLFLRFVGDEKDPLPNDGPDISSREHTFWVLIDNALIFRKHRLVPHDVPIYPWAADDSLNRGLNLIDWRRLSPRAHAAEVVTGTNHLHMIGSPAFHSRLALRLKETEKDIA

SEQ ID NO: 11563 - protein, 484 aa, Sinorhizobium meliloti
MNLKDPSLFRQAALVGETWIEADPKNAIEVNNPATGEIIGRVPKLGAADTRTAIEAAARVQKEWAARTAKERSAVLRRWFELMIENKDDLGRILTMEQGKPLAEATGEIVYGASFIEWFAEEARRVYGDLVPGHQKDKRILVMKQPIGVVAAITPWNFPNAMITRKAGPALAAGCAMVLKPAAQTPFSAIAIAVLAERAGMPKGLFSVITGSAREIGAEMTSNPTVRKLTFTGSTEVGAELYRQSAATIKKLGLELGGNAPFIVFDDADLDAAVEGALIAKFRNNGQTCVCANRIYVQDGVYEAFSDKLAQAVAKLKTGNGMEDGVILGPLIDQPALKKVEEHVADALAKGARVVQGGRRHSLGGTFYEATVLADVTQAMAVAREETFGPVAPLFRFKDESDVIAQANDTEFGLASYFYAKDLARVFRVAEALEYGMVGVNTGLISTAEAPFGGVKLSGLGREGSKYGIEEFMEIKYVCLGGIA

SEQ ID NO: 11564 - protein, 279 aa, Sinorhizobium meliloti
MTARMEQRFADVAAEGRPVLVTYFMGGDPDFDTSLAIMKALRQAGADIIELGVPFSDPMADGPAIQLAGQRALKAGQSLAKTLELARLFRAEDQRTPIVLMGYYNPIYIYGVERFLADALEAGVDGLIVVDLPPEMDDELCIPALEKGISFIRLATPTTDDRRLPKVLENTSGFVYYVSMTGITGSALPDPSLIAGAVARIKAHTPLPVCVGFGVKTADHARAIGASADGVVVGTAIVNQIASSLTEEGRATEATVPGVEALVRGLAAGVRAARLAAAE

SEQ ID NO: 11565 - protein, 445 aa, Sinorhizobium meliloti
MTRVAVIGAGPSGLAQLRAFQSAAQKGAEIPEIVCYEKQSDWGGLWNYTWRTGLDEYGEPVHGSMYRYLWSNGPKECLEFADYTFEEHFGKPIASYPPRAVLWDYIKGRVEKANVRDWVRFNTPVRMVHFDEETKKFTVTAHNRLEDRMYDEEFDYVVVASGHFSTPHVPYFEGVKTFNGRVLHAHDFRDALEFKGKDVLIVGRSYSAEDIGSQCWKYGAKSVTTSYRSKPMGFNWPENFEERPLLTKLENKTAHFADGSTKEVDALILCTGYQHHFPFLPDELRLKTANRLWADHLYKGVVFDKNPQLFYIGMQDQFYTFNMFDVQAWWARDVMMGRIALPPEEELKANFDMWRAREETLEHAEEMIWYQGDYVKELLAETDYPSFDIEGVNRTFMKWEHHKAENIMGFRDNAYRSLMTGNMSPKHHTPWVEALDDSLEEYLRA

SEQ ID NO: 11566 - protein, 211 aa, Sinorhizobium meliloti
MSGTLVLVRHGQSDWNLKNLFTGWRDPDLTELGIEEAKAGGKALADYGIKFDIAFTSVLIRAQRTCQLVLDAVGQSSLETIRDQALNERDYGDLSGLNKDDARAKWGEEQVHIWRRSYDVPPPGGESLRDTGARVWPYYLTDILPRVLSGEKVLVAAHGNSLRSLVMVLDKLTKEQILKLNLATGVPMVYKLNADSTVASKEVLGDMSGAH

SEQ ID NO: 11567 - protein, 379 aa, Sinorhizobium meliloti
MKRDLYETLGVQKNADEKELKSAFRKLAMKYHPDRNPGDQESEKSFKEINEAYETLKDPQKRAAYDRYGHAAFEQGGMGAGFGNGFAGGGAHGFSDIFEDIFGEMMGGRQRRSSGGRERGADLRYNMEISLEEAYSGKTAQIRVPTSITCDVCTGTGAKPGTSPKTCGTCQGTGRVRAAQGFFSIERTCPTCGGRGQTIADPCTKCHGQGRVVEERTLSVNIPAGIEDGTRIRLSGEGEAGLRGGPAGDLYIFLSVKPHEFYQRDGADLYCAVPISMTTAALGGKFDVTTLDGTKSRVTVPEGTQAGKQFRLKGKGMPVLRSSQTGDLYIQIQIETPQKLTKRQRELLQEFEQISSKENNPESTGFFSRMKDFFDTLSE

SEQ ID NO: 11568 - protein, 284 aa, Sinorhizobium meliloti
MTAKTNRISFQGDYGANSDMACRDMFPSMEPLPCQTFEDAFLAVENGEADLAMIPIENTIAGRVADIHHLLPESRLHIVGEYFMPIRFQLMVLPGVGREEIRTVHSHIHALGQCRKIVRANGWKPVVAGDTAGAAKLVKEVGDRSMAALAPRLAADLYGLDIIAENVEDTDSNVTRFVVLSREESRVARTSKDELIITTFVFNVRNIPAALYKAMGGFATNGINMTKLESYQLGGKFVATQFYADIEGHPDDIGVRHAMDELRFFSENVRILGTYPAHPMRGVL

SEQ ID NO: 11569 - protein, 252 aa, Sinorhizobium meliloti
MVIATKFGFRIDPGKPAAEAIKGVDGRPENAKTVAEASLKRLGTDVIDLYYQHRVDPAVPIEETVGAMAELVKEGKVRAIGLSEASAATIRRAHAVHPIAAIQSEYSLWSRDPEQEVLDTCRELGIGFVPYSPLGRGMLTGTIRKVEDLAADDFRRSLPRFQEENFEANAALVATLERLAMERGVTAAQLALAWVVNQGEDIVPIPGARRIEHLEQNVAAAGIVLTGSERAELGEALSPTLVAGNRYTDASR

SEQ ID NO: 11570 - protein, 322 aa, Sinorhizobium meliloti
MPEARKPGRGRVFSSITETIGDTPIVRLDKLAKEKGVKANLLAKLEFFNPIGSVKDRIGVAMIESLEAQGKITPGRTTLVEPTSGNTGIALAFVAAAKGYRLILTMPETMSVERRKMLTLLGAELVLTEGAKGMKGAIAKAQELTETLPDAIIPQQFENPANPEIHRTTTAEEIWNDTEGAVDILVSGIGTGGTITGAGQVLKARKPSVRVIAVEPEESPILSGGAPGPHKIQGIGAGFAPAILDTSVYDEVVTVNAGEAIEAARLVARLEGVPVGISAGAALQAAIEVGQREENAGRNIVVIIPSFAERYLSTVLFEGLGA

SEQ ID NO: 11571 - protein, 473 aa, Sinorhizobium meliloti
MAKILTPDICVIGGGAAGLSVAAGAAAFGVPVVLVEHGRMGGDCLNYGCVPSKALIAAAKHADAIRKAAEFGIASAEPIVDHEHLTARIQSVIEAIAPHDSAERFTSLGVEVIKETARFVDDRTVAAGDRMIRARRFVVATGSSPAIPPIPGLAETPFLTNETLFGLKRLPRHLLVIGAGAVGLEMAGAHRRLGADVTVVDSAAALSGQDPELAAIVLDGLRAEGMLLHERTVIRSAEQTETGIRLICENESGPFEIEGSDLLVAAGRAPNHGSLDLDAAGIRHCPKHVEVGADLRTSNRRVYAVGDAAGGLFTHQASYHARLVLQQILFRLPGRERTTIVPQVIFTAPELAQVGLTEERARESARGARTVRLDFSASDRARTDGLDRGLIKIVVGRRGRVLGAGIAGPGAGEMIGLWAFAVANRLTLRHFQTYVAPYPTLSEIGKQAAISYYSPMARNRLLRTAIRFLRNFG

SEQ ID NO: 11572 - protein, 1233 aa, Sinorhizobium meliloti
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAEALLRIPDTATRDALIRDKIADGNWKSHLGGSRSLFVNAATWGLVVTGKLTSTVNDRSLAAALTRLISRCGEPVIRRGVDMAMRMMGEQFVTGETIREALKRSKELEEKGFSYSYDMLGEAATTAADAERYYRDYESAIHAIGKASAGRGIYEGPGISIKLSALHPRYSRAQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYIACAAKLLAATDVVFPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAELFGDARTNSAGLDLSNEETLASLTEALRESAAMKWTALPQLATGPAAGETRTVLNPGDHRDVVGSVTETSEEDARRAVRLAADAAPDWAAVPPSERAACLDRAAELMQARMPTLLGLIIREAGKSALNAIAEVREAIDFLRYYAEQTRRTLGPGHGPLGPIVCISPWNFPLAIFTGQIAAALVAGNPVLAKPAEETPLIAAEGVRILREAGIPASALQLLPGDGRVGAALVAAAETAGVMFTGSTEVARLIQAQLADRLSPAGRPIPLIAETGGQNAMIVDSSALAEQVVGDVITSAFDSAGQRCSALRVLCLQEDVADRILTMLKGALHELHIGRTDRLSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEAEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 11573 - protein, 308 aa, Sinorhizobium meliloti
MIVCCGEALIDMLPRETTAGESAFAPYAGGAIFNTAVALGRLGVPTGFFTGLSDDMFGDILRATLKAANVDFAPCATLPLHTTLAFVKLVDGHASYAFFDENTAGRMITAEHLPALGDFCEALHFGAISLIPEPCGSTYEALMAREHEKRVISFDPNIRPGFIKDREAHVGRMNRMAAMSDIVKFSDEDLAWFGMEGSHDALAAEWLKRGPKLVLITRGADGAVGYTNGHKVEVASERVEVVDTVGAGDTFDAGVLASLKFNNLLTKERVASLTDEAIRQALTLAAKAAAVTVSRAGANPPWRHELGL

SEQ ID NO: 11574 - protein, 399 aa, Sinorhizobium meliloti
MAATTPLYDTYLRAPLRFERGEGVWLIAEDGTRYLDFAAGVAVNSLGHAHPHLVEALKAQADKVWHLSNLYEIAGQESLARRLTQVTFADRVFFTNSGAEALECAIKTARRYHFAKGHVEKFHVITFEGAFHGRTLATIAAGGQQKYIEGFGPKAPGFYQVPFGDIGAVKNAINEETAAILVEPIQGEGGIRTASKEFMQGLRELCDEFGLLLILDEVQSGVGRTGKLFAHEWAGIKPDIMAVAKGIGGGFPLGACLATEAAAAGMVAGTHGSTYGGNPLAMAVGNAVLDVVLAEGFLDQVREVALVFRQGLASLKDRFPDVIEEIRGDGLMLGIKAKVPSADLLKAIRAEKLLVVPAGENVLRLLPPLITTPAEAREGLARLERAAEAVSGKSGNAAA

SEQ ID NO: 11575 - protein, 412 aa, Sinorhizobium meliloti
MAFEKGGVWRNWVGNQYCVSQYKASPGTEAELAELVAEADKRDLGVRVSGSGHSFTPVVGTSGLLLSLADLRGVQKVDKARKQITVAGGTRINEVGKTLKQHGLSLINQGDIDSQAVAGAFTTGTHGTGIKLGNMASSIAGMRIVKANGEILDIDGSDEELLHAAQVSVGTLGIISSMTLNVMDAYNLHERLWRDDFETCMERHDELAANHRHFGFFWCPTPESRHLYCLPDTSAVSSTNKSADVCEMKVMDITDAAPMESEFEKIAYSSEVYPIEYVPNFVELEYAVPVEHGKAAVRAVRDLMLNKHTNCIYPIEYRFTAGDPAWMSPFHHQDSITLSVSGGPGIDYWAFLKGVDQILRGYDSRPHWGKMHFLDTDDVTHLYPRAGDFRALRRELDPKGRFLNDHLKMLLG

SEQ ID NO: 11576 - protein, 500 aa, Sinorhizobium meliloti
MARIIETATGLEALTFDDVLLQPGHSEVMPGQTNIATRIAQDIELNLPILSAAMDTVTEARLAIAMAQAGGIGVIHRNLTPAEQAEEVRQVKKFESGMVVNPVTIGPDATLADALGLMKAHGISGIPVVENGGLGGQTQGRLVGILTNRDVRFASDPSQKIYELMTRENLITVKESVDQQEAKRLLHKHRIEKLLVVDPEGRCVGLITVKDIEKSQLNPNAAKDAQGRLRAAAAVSVGDDGFERAERLIDAGVDMIVVDTAHGHSQRVLDAVARVKKLSNSVRIMAGNVATGDGTKALIDAGADAVKVGIGPGSICTTRIVAGVGVPQLAAIMAAVDAAQAAGIPIIADGGIKFSGDVAKAIAAGASAVMIGSLLAGTEESPGEVFLYQGRSFKAYRGMGSVGAMARGSADRYFQAEVRDTLKLVPEGIEGQVPYKGPVSGVLHQLAGGLRASMGYVGGATIKDYQERATFVRISGAGLRESHAHDVTITRESPNYPGGA

SEQ ID NO: 11577 - protein, 405 aa, Sinorhizobium meliloti
MSGRLVVVGGGQAAFALVAKLRALKDMRPITVVAAEASLPYQRPPLSKKYLLREMTLDRLLYRPEAWYAEHEIDIRLSTTVTRVDRLAKQVALSDGSMLTYETLAFATGATPRRLPAAVGGDLAGVFVVRDFRDADRLAEEMQPGRRVLVVGGGYIGLEAAAVARTSGLEVTVIEMADRILQRVASAATSAIVREIHRSHGVDIRERTGLHRLIGDNGRVTAAELSDGSVIPVDIVIVGIGVAANDALAHEAGIETANGIVVDSHGRTSDPTIVAMGDCAVLPWDGMRIRLESVQNAVDQAEAVAAVLAGGTDPYDPKPWFWSDQYDVKLQIAGFGLGHDETLVRQGQRQGSVSVWYFRQGKLIAVDAINDAKAYVTGKKLLEAGATPDRLLLADPQVDLKALLV

SEQ ID NO: 11578 - protein, 498 aa, Sinorhizobium meliloti
MPLAEAVALHASERPHSPAFRMEGRVFTFGELAAGAKRILPAVQRSAAEATERSILSGPVRLVALETGNHPLFPAAFIAATAAGHCAALIDPHLPEIVRRRMKERLRPEVVIRAEGDLLRIDVPSAGQSRLLQGASDAPPAIPAGDGGEPFLVVFTSGTTGEPKPIIRNRRSWRVSLKTGQGFFGLGPETTTYAPGPLAHGLTLYALAETLTAGAEFVGARHFEADQVLATIAATGAKRLVLVPTMLRRLCERAAGSPLTSVGQITVAGAKLTTADRDAARRAFPEAQVTEYYGASELGFISVSRAKDRHTPTAVGKAFPGVRLEIRDERGERLPAGETGTIFVESELISDGYIAGGDGAGFRRQGKLATVGDLGFLDEDGTLHLIGRAGGMVVSGGNNIYPSEVETVIQGAGGVNAAFVFGLHHPDLGSELAAVIEPGDGFDHAALERHLAADLPRYKRPRRIWLCRKMPMTASGKVAAGELRQWIATENSALERLV

SEQ ID NO: 11579 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQRNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADVTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 11580 - protein, 327 aa, Sinorhizobium meliloti
MTYVDLPGPGGPENMVLARGPLPEVRPGDILIRVEAFGINRPDVLQRKGDYPLPAGASPILGLEAAGEVVALGEGATGFSTGDKVCALANGGAYAEYCAVPATQALRWPKGYDAAKAAALPETFFTVWANVFDMARLKSGETFLVHGGSSGIGTTAIQLARAFGAEVFATAGNAAKCEACEALGAKRAINYREEDFKAVVLQETGGRGVDVILDMVGGRYFDRNIGSLAKDGRLSIIAFLGGARVDGANIAPILMKRLQVMGSLLRPRTAAEKQAIRDGLAEKVWPLLEGGDVAPVIQAVLPFAEIAGAHRLMEEGDHIGKIVMRIG

SEQ ID NO: 11581 - protein, 487 aa, Sinorhizobium meliloti
MILGRRQFRHLPANIRKPTSMAKARTQFVCQNCGTVHSRWVGKCDGCGEWNTIIEDNPTAGIGGGPMRTPKKGRPVALTTLSGEIEDAPRIQTGISELDRVTGGGFVRGSALLVGGDPGIGKSTVLMQAAAALARRKHRVIYVSGEEAIAQVRLRAQRLGAADSDVLLAAETNVEDILATLSEGKRPDLVIIDSIQTLWSDIVDSAPGTVTQVRTGVQAMIRFAKQTGTAVVLVGHVTKEGQIAGPRVVEHMVDAVLYFEGDRGHHYRILRTVKNRFGPTDEIGVFEMSDKGLREVANPSELFLGERNAKSPGAAVFAGMEGTRPVLVEVQALVAPTSLGTPRRAVVGWDSARLSMILAVLEAHCGIRLGQHDVYLNVAGGYRISEPAADLAVASALVSSLAGLALPPDCVYFGEVSLSGAVRPVAHTAQRLKEAEKLGFSQAVLPSASTELPKNGNGRWSEMESLPDLVARIAGSRRALQQTNDED

SEQ ID NO: 11582 - protein, 318 aa, Sinorhizobium meliloti
MANKSIDHAITAKSLTTAASDPTHAGILSFMRRKYTKELKGVEAVVWGIPFDAATSNRPGARFGPQAIRRASAIFDNDPQYPFQRDLFADMATIDYGDCLLDYGNHARTPQTIEREASKILKSGAYLLTLGGDHFVTYPILRAHAALHGPLALVQFDAHQDTWPDEKGRIDHGAFVGRAAREGLIDVERSIQIGIRTHAPEDCGIRIVYGYELEEMRAEEIADTIIRHVDNRPAYLTFDIDCLDPAFAPGTGTPVAGGPSSAKILSVLRKLGALHIAGSDVVEVAPAYDHADLTAIAGSTIAMYMLGLRAEWLAERRG

SEQ ID NO: 11583 - protein, 187 aa, Sinorhizobium meliloti
MGPPGAGKGTQAKLLTERYGIPQLSTGDMLRTAVAQATEVGKRAKAVMDAGQLVSDEIVNEIVSDRIDSADCARGFILDGYPRTVPQAVALDRMLEEKGLKLDAVIELKVDEAALVRRMENRVTETVAAGGTVRSDDNPEAFRRRLQEYREKTAPLSEHYARTGRLKTVDGMADVHTVTAEIEKILA

SEQ ID NO: 11584 - protein, 375 aa, Sinorhizobium meliloti
MDVRAAVALEAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 11585 - protein, 150 aa, Sinorhizobium meliloti
MTLTFASPPQDKAELESGPAFTPRFDEKGLITAVVTDARDGELLMVAHMNAEALSLTLETGFAHYYSRSRDRLWKKGESSGNLQTVREIRTDCDQDAVWLKVSVAGHDATCHTGRRSCFYRTVGVADGEAKVAITDDHRHFDPAQIYAGN

SEQ ID NO: 11586 - protein, 256 aa, Sinorhizobium meliloti
MTPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 11587 - protein, 424 aa, Sinorhizobium meliloti
MTAIIDIIGREILDSRGNPTVEVDVHLEDGSFGRAAVPSGASTGAHEAVELRDGGTRYLGKGVERAVDAVNGEIFEAIGGLDAENQIQIDRTMIELDGTPNKSRLGANAILGVSLAVAKAAAEASGLPLYRYVGGPNAHLLPVPMMNIINGGAHADNPIDFQEFMIMPVGAETLKDAVRMGSEVFHTLKKQLAADGHNTNVGDEGGFAPGLASAPAALDFIMKSIEKAGYKPGEDMYVALDCASTEFFKDGKYVLEGEGRTLEPGAMAEYLAELAGKYPIISIEDGMAEDDWDGWKSLTDLVGNKCQLVGDDLFVTNSARLRDGIKMGVANSILVKVNQIGSLSETLDAVETAHKARYTAVMSHRSGETEDSTIADLAVATNCGQIKTGSLARSDRLAKYNQLIRIEEQLGPQAQYAGRSVLRG

SEQ ID NO: 11588 - protein, 481 aa, Sinorhizobium meliloti
MAENYDVIVVGSGPGGYVTAIRSAQLGLKTAIVEREHLGGICLNWGCIPTKALLRSAEILDHANHAKNYGLTLEGKITANVKDVVARSRGVSARLNGGVAFLMKKNKVDVIWGEAKLTKPGEIVVGAPSKPAVQPQNPVPKGVKGEGTYTAKHIIVATGARPRALPGIEPDGKLIWTYFEAMKPEEFPKSLLVMGSGAIGIEFASFYRSMGVDVTVVELLPQIMPVEDAEISAFARKQLEKRGLKIITDAKVTKVEKGANDVTAHVETKDGKVTPIKADRLISAVGVQGNIENLGLEALGVKTDRGCIVTDGYGKTNVAGIYAIGDVAGPPMLAHKAEHEGVICVEKIAGVPGVHALDKGKIPGCTYCDPQVASVGLTEAKAKELGRDIRVGRYSFGANGKAIALGEDQGLIKTIFDKKTGELIGAHMVGAEVTELIQGFVVAMNLETTEEELMHTVFPHPTLSEMMKESVLDAYGRVLNA

SEQ ID NO: 11589 - protein, 280 aa, Sinorhizobium meliloti
MQQSDDQILATLRDTDRDRYLACLLSPAEKRHSLAALYAFYAEIARVRDMVKEPLPGEIRLQWWRDTLENEQSDGAGHPLAEALLRCIREHHLPVRVLQDMIDARIFDLYDDPMQDRAALEGYAGETASALIQLSSLILDPDNAARSADAAGHAGVAQTVAGLLLLLPVHVGRGQVYLPAELLSATGLDRETLLAGTDESAIERAVRAFCGLGRDHLAKAREGAGAISGRNFSAFIPVALAEPVFDRAEAAGARILRQSLQPPQWQRQWRMWRASRRREF

SEQ ID NO: 11590 - protein, 373 aa, Sinorhizobium meliloti
MASLFDPITIGDISLSNRVVMAPLTRNRSPQAVPNDLNVAYYEQRASAGLLITEGTAISHQGQGYADVPGLYKPEALAGWRKVTDSVHKAGGKIVVQMWHVGRISHDSLQPQGGKPVAPSAIRAKSKTYLVNPDGTGSFAETSEPRALEPAEIAGIVEDYRKASRAAIEAGFDGVEIHAANGYLIDQFLRSGSNERTDAYGGSIENRARFLFEVVDAVTKEIGAGRVGIRISPVTPANDAFDPDPQPLFTYVVEGLARYPLAYVHVIEGATGGARDHQQGDRPFDYTSLRAAYAAAGGRAAWMTNNGYDRGLALKTVESGEADLVAFGKPFIANPDLVRRLRDNVALNAPDQATFYGGGAKGYTDYPSLENVA

SEQ ID NO: 11591 - protein, 467 aa, Sinorhizobium meliloti
MLTATKDLVLAQSDNSWPTHFRASLYLGVPFIGAQLAQLAINTTDVLMVGQLGATQLAAIILATQVFFTIFIFGSGFANAVVPMVAQAQGRGDQVSVRRSVRMGMWVVLLYGVLTAPVLWMAEPILLFAGQKPEVAALAGEYLHIAQWAIFPSLIFMVLRAFLSGLERAGVILYVTLVTLVLNAALCYVLIFGHFGFPELGIFGAAVAALGVALLGAALTIGYIRRQPELHRFELFVRFWRPDWPAFGEVVHLGIPISVTILAEVSLFTVASLLMGTIGTIELAAHGIALQFASIAFMIPLGLAQAGTVRIGLAYGSGDMVGVKRAAIAVLTLGVGFAAVGSTIFALFPHELAGLYLDTRRPDAAEVLAFAGPLIVIAGAFQLVDGLQAIAAGMLRGLKDTTIPMILAMIAYWPIGFFCAWAFAFPLGFGGVGVWFGFVLGLASAALLLNWRFFRLLRRVSAAPAAS

SEQ ID NO: 11592 - protein, 190 aa, Sinorhizobium meliloti
MKILQFAVAGALALAAFTGGALAQSGENILTVQLEDGPVVIELRPDIAPKHVQQIKELAAAGEYDNVAFHRVIKGFMAQTGDVEFGDMKDGFQGDRAGTGGSSKPNLPAEFSDVPFERGTVGMARAQDPDSANSQFFIMLAPGDFLNGQYTVVGKVVEGMENVDKIKLGDDANNGAVADPDRMISVKVGR

SEQ ID NO: 11593 - protein, 169 aa, Sinorhizobium meliloti
MAEIKDPENTIIMETTKGRVVIELRPDVAPGHVARIKELTREGAYDGVVFHRVIEDFMAQTGDVQYGKTGGEQFNPSRAGMGGSSKPDLKAEFSDVSHVRGTCSMARSQMPNSANSQFFICFTDAPWLNKQYSVWGQVVEGMENIDNIKRGEPVRDPDTIVSMRVAADA

SEQ ID NO: 11594 - protein, 361 aa, Sinorhizobium meliloti
MANAGIRSVQREVFNMPVLPSVLEAIGNTPLIRLKAVSEATGCNILGKAEFLNPGQSVKDRAALWIIRQAEKSGQLRPGGVIVEGTAGNTGIGLAVVGSALGYRTVIVIPETQSQEKKDALRLLGAELVEVPAVPYRNPNNYVKISGRLAAQLAETEPNGAIWANQFDNVANRQAHVDTTAPEIWRDTDGKVDGFICAVGSGGTLAGVAEGLRARNAAIKIGIADPEGAALYNFYAHGELKSSGSSITEGIGQGRITANLEDFTPDFAYQIPDAEAVPYVFDLIEKEGICVGGSTGINIAGAVRLARDLGPGHTIVTILCDYGNRYQSKLFNPDFLTSKGLPVPDWLKTASNIAVPYEPAG

SEQ ID NO: 11595 - protein, 494 aa, Sinorhizobium meliloti
MLQALSNVLVTPAEMTAVDKDAARSGIDSFSLMRSAGTAVSAAALRLYPEALRFVVLCGPGNNGGDGYIAAAALADTGASVAVFALGDAAMLKGDAARARDAFALVPRPLDAYGPQSGDVVIDALFGAGLARDVPDEARTVIEQVNASGVPVLAVDLPSGIDGRTGEIRGLSFVAAHTVTFMAAKPGHLLMPGRARCGTLEIFDIGIPARLVADRAGDLHVNTPAMWEQHLGALDPATHKYKRGHLAVLCGGPVSTGAARLSAAAGLRAGAGLVTLASPAEALAVNAAHLTAVMLKEINNAAGLAAWLKDRRLNAFVLGPGFGVGKKARDFVLMLCGRALVLDADGISSFREGREQLFDRIAAEGGEVVMTPHEGEFARLFPDIAEDAALSKIEKAQAAARLSHAVIVYKGPDTVVAAPSGRAAVNVNAPPWLATAGSGDVLAGIIGAHLAQGMPAFQAAASAVWRHGEAGVVAGRTATAESLVESIAPLRGNA

SEQ ID NO: 11596 - protein, 467 aa, Sinorhizobium meliloti
MNQYDLIVVGSGPAGRRGAIQAAKLGKKVLVIEQGKRVGGVSVHTGTIPSKTLRETALNLTGWRERGFYGRSYRVKQEISAEDLRRRLIITLNHEVEVLEHQFARNRVQHIRGRASFVGPTTLEISKDDDESMLVSGTSILLAVGTKPFRPDYMPFDGRTVVDSDELLDIRELPRSLVVIGAGVIGIEYATIFSALDIQVTVIDPKTTMLDFIDREIVEDFTYQLRDRAMKLNLGQKAEKVERLDNGKVLLTLDNGRKITTEMVLFAAGRMGATDALNLPAAGLEADARGRLKVNPETFQTTVPNIYAAGDVVGFPSLASTSMEQGRVAARVAVGAIAKEPQKYFPYGIYAVPEISTCGLSEEEVKERGIPYECGIARFRETSRGHIMGLDSGLLKMIFSLRTRRLLGVHIIGEGATELVHIGQAVLNLKGTVEYFVENTFNYPTLAEAYKIAGLDAWNRMGEIKAE

SEQ ID NO: 11597 - protein, 226 aa, Sinorhizobium meliloti
MMTHPIRIAPSILAADFSKLGQEVRDVAEAGADWIHLDVMDGHFVPNITFGPDVIKSLRPHTRATFDCHLMIAPADPFLEAFAKAGCDIITVHAEAGPHLHRSLQTVKSLGKKAGVSINPATPESAIEYVLDTVDLILVMTVNPGFGGQKFVGATEEKIRRIKAMIGSRPIEIEVDGGIAPDTAGVAAKAGANVLVAGSAIFKGDSVDAYRSAIEVLRTQAQKARG

SEQ ID NO: 11598 - protein, 315 aa, Sinorhizobium meliloti
MREPKPQEDLQAIIDDIYRELTPRLGEGKVADYIPQLARVDARHFGMAIVTTGGEVYRVGDAEMPFSIQSISKVFTLTLALGKHGENIWNRVGREPSGSAFNSIVQLEHEGGKPRNPFINAGAIRISDLILAGHTPKELIGEIVRFVRYLADDENIVIDHEVARSETATGYRNIALANFMRSFGRLDHPVEHVLGVYFHHCALAMTCSQLAKAGLFLAAGGTNPLTGHSVVSRQRARRINALMLTCGHYDGSGDFAYRVGLPGKSGVGGGIMAVAPGKASIAVWSPGLNDYGNSLLGSLALEMLAARTGWSVFGP

SEQ ID NO: 11599 - protein, 269 aa, Sinorhizobium meliloti
MVQAVIEKQADAGGEREAVLSVRDLTVGFGDHVVLDNLNLEVLRGEILGFVGASGTGKSVLMRTVLRLLPKRSGTIEILGADYDSMGEAERIALDMRLGVLFQHGALFSALTVRENIQVPMREYLDLPQDLMDELARLKIELVGLAPEAAEKYPSELSGGMIKRAALARALALDPDLVFLDEPTSGLDPIGAAEFDELIAKLRDTLGLTVYMVTHDLDSLFSVCDRIAVLGKKRVLVEGTIEDMLACDEPWVKSYFRGKRARAIVREQD

SEQ ID NO: 11600 - protein, 463 aa, Sinorhizobium meliloti
MSAFDYDLFVIGGGSGGVRSGRLAAALGKKVAIAEEFRYGGTCVIRGCVPKKLYVYASQFAEHFEDAAGFGWTVGESRFDWAKLVAAKEQEIARLEGLYRKGLANAGAEILDTRAELAGPNTVKLLASGKTVTAERIVIAVGGHPSPHDALPGHELCITSNEAFDLPALPESILIAGGGYIAVEFANIFHGLGVKTTLIYRGKEILSRFDQDMRRGLHAAMEEKGIRILCEDIIQSVSADADGRRVATTMKHGEIVADQVMLALGRMPNTNGLGLEAAGVRTNELGAIIVDAFSRTSTPGIYALGDVTDRVQLTPVAIHEAMCFIETEYKNNPTSPDHDLIATAVFSQPEIGTVGITEEEAARKFQEIEVYRAEFRPMKATLSGRKEKTIMKLVVNAADRKVVGAHILGHDAGEMAQLLGISLRAGCTKDDFDRTMAVHPTAAEELVTMYQPSYRVRNGERVG

SEQ ID NO: 11601 - protein, 289 aa, Sinorhizobium meliloti
MAKVAFIGLGVMGYPMAGHLKARGGHDVTVYNRTAAKAEQWAAAFGGRTAATPAGAAKDQDFVFACVGNDDDLRSVTTGENGAFETMAPGSVFIDNTTASAAVARELYAAAAAKGAHFIDAPVSGGQAGAENGVLTVMCGGDAGAFDKAKPVIEAYARMVGLMGPAGAGQLTKMINQICIAGLVQGLAEGIHFGKKAGLDIEKVIEVISKGAAGSWQMENRHKTMNEGKYDFGFAVDWMRKDLDIVLAEARHNGAKLPVTALVDQFYGDIQALGGNRWDTSSLLARLEK

SEQ ID NO: 11602 - protein, 192 aa, Sinorhizobium meliloti
MKTLDVFLTSTGLALMVGFSTSTTIPAHAQNLTGPMLVAEQCSPLTDANYEACCMAQNRADILTAGQIEQCPPLSTAAIGNSFSTTSTDSGPRNLNGDDGGGGNPGGGGGGGGGGGGGGGGGGGGGGGGGGGGDPGGGGGQDTGKGNQDHGKGNQDNGKGSQDNGKGSQDNGKGSQDNGKGSQDNGNQDPQR

SEQ ID NO: 11603 - protein, 250 aa, Sinorhizobium meliloti
MRRTGKTIIGSLLGLAYVVATPFASLASFDDGLRQSTALAGPHGDVLVVADAGSAPGGSQETGSGGGQDTGSSGGQDSGSGGGEGSGGGQDTGSGGGQDTGSGGGQDTGSGGGQDSGSGGGEGSGGGQDSGSGGGQDTGSGGGQDTGSGGGQDSGSGGGEGSGGGQDSGSGGGQDTGSGGGQDSGSGGGQDSGSGGGEGSGGGQDTGSGGGQDSGSGGGEGSGGGQDSGSGGGQDTGSGGGETPASTSSD

SEQ ID NO: 11604 - protein, 491 aa, Synechococcus elongatus PCC 7942
MPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGPPGALTGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSLKKSYKAWILANTGWKPTLALPRMHLTP

SEQ ID NO: 11605 - protein, 476 aa, Sinorhizobium meliloti
MSQAEIGLIGLGVMGSNLALNIAEKGNRIAVFNRTVDATRKFYAEAGALKDQIVPCETIEEFVAAIRPPRPIIIMIKAGDPVDQQMEALKPHLAKGDIMIDAGNANFRDTMRRFDALKDSGLTFIGMGVSGGEEGARHGPSIMVGGTEESYRRVEKVLTSIAAKYDSDPCVAWLGENGAGHFVKTIHNGIEYADMQMIAEIYGILRDGLKMTAQEIGEVFGAWNKGRLNSYLIEITEKVLKAADPLTGKPIVDMILDKAGQKGTGKWSVIEAQNMGVPATAIEAAVAARSISSAKEEREAAEKVLGLPPVGEIKVADRDGFIKDLENALLAAKIGAYAQGFAVMAAASKEFGWNLPMPTIAKIWRAGCIIRSQFLDEITTAFTKAPDAANLIVTPAFAAMVKESDGALRRVVSTAVLGGLPVPALASALGYFDSYRRGRGTANVIQAQRDFFGAHGFDRVDGADSHHGPWGSGLNA

SEQ ID NO: 11606 - protein, 233 aa, Sinorhizobium meliloti
MKRINRSIFRTFFILSTATIGAVIVTTDADAVQRQRMTARQCSPLSEDNFAACCVAINRTKILTPAQIKMCPPLTTASIGAGTGRHDRSDSTASGPMRGGGKGGGSKGGGGVGGGGGGGGGGGGGGGGGGGGGGGGGGDNGGGGQDPGKGDQDNGKGNQDGGKGHQDNGKGGQDGGKGHQDNDKGNQDGGKGHQDNDKGNQDGGKGHQDNNKGDQDGRGKGGKDKGGKAKGDK

SEQ ID NO: 11607 - protein, 482 aa, Sinorhizobium meliloti
MVPTGGSSPVIRQLESAFTKIGVTGAHKQILALVLIGCLFDSFEQNTIGVAGPILKEHWGLTGTDIGFLNTITFGSAAIGRLLSGILGDRYGRRVMLTINLLLFTIGSAACAMAPNFTMLCFARAIVGFGVGGEISTAVTMLSEFCSPKFRGTAAGLVNVGAGGFGNFLAPAFGLLIFTLFPGENSWRWLFASLALPALLVVFYRRFVPETPRFLASKNKIGEANKVLSILASGSLKPRNLVVHEYLTTDHMTDEAPEKSDWRELFRAPFIGRTIPVAIAILMSYGAQLSVLTLMPVIFVSMGYTLSGSLLYSMIIQSGSVLGAIAASMFGYYLPRKKVLTVGAALACLAAVSIVTLGTNIYLVLLFGAIFQFFVLLLNTSIWIYAPELFPTRIRAFGVALILATGSAAGSFVPTISGMLFDSYGMVGVFGLAAGMYAVFAFCIQLGPETYGRSMEDLSQPAEADQPKVAQQQGPVAVELRT

SEQ ID NO: 11608 - protein, 228 aa, Sinorhizobium meliloti
MFRKLSVEFLGTFWLVLGGCGSAVLAAAFPEVGIGLLGVSFAFGLTVLTMAYAVGGISGGHFNPAVSVGLAVAGRMPPASLVGYILAQVTGAIAAAAVLYVIASGKADFQLGGFAANGYGEHSPGGYSLTAALVTEVVMTAFFLLIILGSTHSRVPVGFAPIAIGLGLTLIHLVSIPVTNTSVNPARSTGQALFVGDWAISQLWLFWVAPLIGAVIAGIVWKIVGDDS

SEQ ID NO: 11609 - protein, 255 aa, Sinorhizobium meliloti
MSKSGLWVGTSWKMNKTLAEAMVFADGLAAADDARDQRIQRFVIPPFTAARQVKERLKATSVKVGAQNMHWDDAGAWTGEISPVMLSDCDLDIVELGHSERREHFGETDRTVGLKTAAAVKHGLVPLICIGETLAQREAGEADTVLKRQVEGAFAFLEGAARKAPVLLAYEPVWAIGVNGIPATADYADARHRLIGEVAERALGVKVPVLYGGSVNPQNCEELILQPHIDGLFIGRSAWDVGGYLDILQRVARAI

SEQ ID NO: 11610 - protein, 386 aa, Sinorhizobium meliloti
MNFALTEEQQMIVDTVRTFVETEIYPHENEVERTGVVPRELGLEIARKCKELGFFACNFPEEVGGAGLDHLTFTLVERELGRGSMGLTVFFGRPSGILMACNEDQRERYLLPAVRGDKFDALAMTEPDAGSDVRGMKCFARPDGDDWIVNGTKHFISHADIADFVIVFIATGEEQTPRGPKKKITCFLVDRGTPGFEIREGYNSVSHRGYKNCILTFDDCRLPSAQILGEVHKGFDIANDWLYATRLTVAATSVGRARRAFDYALSYAAERKQFGKPISANQGVSFKLADMITEIDAADLLTLSAAWRLDQGLPSNREIASAKVFATEMLARVTDEAIQIYGGMGLMDDLPLARFWRDARVERIWDGTSEIQRHIISRDLLRPLGA

SEQ ID NO: 11611 - protein, 307 aa, Sinorhizobium meliloti
MDSKTTKPMPTEAGIRAFHERCEAFYPADAVNASVEQQRQWYDALCAEFDAPSPEGLTRRDERVAGRIPVRYYRPAEVASGTRVFYIHGGGFVVGSLESHDAICAELAHGAQVELVSVDYRLAPEHLWPAAFEDCCDVLEALLADGRPLVVAGDSAGGNLSAGIVLKAKAEGLAGIVGQVLIYPGLGGDLTRGSYIEMAQAPLLSTADVDYYREVLKAPADEPFAHPLRAADLSGLPPAYVSGAYFDPLRDDARAYAARLAQAGVDVTYREEPQMVHSWLRARRMSPGAREGFVRLVQAVARLAGTA

SEQ ID NO: 11612 - protein, 475 aa, Sinorhizobium meliloti
MDTQLLIGSRFEAGTEAEEHILNPRTGAGIIDLAEASHAQIDAAVDAAERAFVGWSQTTPAERSNALLKIADAIEKEADEFAALEALNCGKPINAVKNDELPAIIDCWRFFAGAVRNLHAPAAGEYLPGHTSMIRRDPIGIVGSIAPWNYPLMMMAWKLAPAIGGGNTVVFKPSEQTPLTALKLARLIADILPEGVVNVITGRGETVGNALINHPKVGMVSITGDIATGKKVLAAAAKTVKRTHLELGGKAPVIVYGDADLEAVVNGIRTFGYYNAGQDCTAACRIYAEAGIYEKLVADLTSAVSTIRYNLDDDTENEIGPLISRRQRDRVASFVERAADQKHIEITTGGRTGSDEGFFFQPTVVAGATQEDEIVRREVFGPVVSVTRFTGKDDAVAWANDSDYGLASSVWTKDISKAMRAASRLQYGCTWINTHFMLTNEMPHGGIKQSGYGKDMSVYALEDYTAVRHIMINHG

SEQ ID NO: 11613 - protein, 502 aa, Sinorhizobium meliloti
MLHQKIVENPYKQKYGNFIGGEWREPVAGRYFDNTTPITGGTLCEVARSDAADIEIALDAAHAAREKWGRTSTTERSNILMKIAARMEDNLELLARAETWDNGKPIRETMAADIPLAIDHFRYFAACIRAQEGSIGEIDHDTVAYHFHEPLGVVGQIIPWNFPILMAAWKLAPALAAGNCVVLKPAEQTPGSILVWAELIGDLLPPGVLNIVNGFGLEAGKPLATSPRIAKIAFTGETTTGRLIMQYASQNLIPVTLELGGKSPNIFFADVASEDDDFFDKALEGFAMFALNQGEVCTCPSRALVQESIYDRFMERAVKRVEAIRQGNPLDEATMIGAQASSEQLEKILAYIEIGKEEGAEVLTGGGRNVLEGDLSGGYYVKPTVFHGHNRMRIFQEEIFGPVVSVTTFKTEAEALEIANDTLYGLGAGVWSRDANRCYRFGRAIEAGRVWTNCYHAYPAHAAFGGYKQSGIGRETHKMMLDHYQQTKNMLVSYSPKALGFF

SEQ ID NO: 11614 - protein, 442 aa, Sinorhizobium meliloti
MSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGMNHVLYTNSGSESVDTALKVALAYHRAKGNGSRFRLIGRERGYHGVNFGGISVGGIVANRKMFGTLLTGVDHLPHTHLPAKNAFSRGEPEHGADLAAELERIVTLHDASTVAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYREEGLLTRAAELAPYWEEALHSLKDCPHVIDIRNIGLIGAVELEPIAGEPTKRAFSAFLKAYEKGLLIRTTGDIIALSPPLIIEKRQIDELFDKLRDVLKNNI

SEQ ID NO: 11615 - protein, 305 aa, Sinorhizobium meliloti
MTGKLLSIGECMVELMQAERDMLRKGYAGDTFNTAYYARLFLPADWTVDYFTAVGTDTVSDELLAFIESTGVGTAHIRRIEGRTPGLYMIHLKDGERSFSYWRSTSAAKLLADDPDRLRAAIEAANVVFFSGITLAILSPDAAETLLAELRRAKAGGRQVVFDPNIRPRLWDDAARMRATIEAGGRAATMVMPSFDDEATHFGDASVEATIERYRALGAENVAVKDGKNGVTLCFAGKERVHVPASQVSAVVDTTSAGDSFNGSFLARLASGDSPADAAAFAARIAAAVIGHHGALIGRDKLPRG

SEQ ID NO: 11616 - protein, 453 aa, Sinorhizobium meliloti
MGTTQSGILGGRLPLAEYEANFSDLHPSLDRHEALVAADRCYFCHDAPCMTACPTSIDIPLFIRQIATGNPIGSAKTIFDQNILGGMCARVCPTETLCEEACVRNTAEERPVEIGRLQRYATDIAMRENKQFYSRAARSGRRVAVVGAGPAGLACAHRLAVKGHDVVIYDAREKSGGLNEYGIAAYKAVDDFAQREVEYVLSVGGIEVSHGKALGRDFSLADLAEEFDAVFLGLGLAGVNALRIEGENAEGVEDAVDFIAALRQSKTKADIPVGRRVVVLGGGMTAIDAAVQAKLLGAEEVTICYRRGKEHMNASEFEQDLAASKGVTIRHWLQPKRIAVKDGRVAGIELDYTTLENGKLTTTGETGIIAADQIFKAIGQAFEASGLGALRMESGRIVVDSEGRTSLEKVWAGGDCVLGGEDLTVSAVAMGRDAAGSIDRAFAVAQPLASAVA

SEQ ID NO: 11617 - protein, 325 aa, Sinorhizobium meliloti
MMTAKPRILITRRWPQAVERVLAERFDTVLNEEDRPLDRSALADALRNFDAVLPTVSDRLPADVFTGGGLRTRILGNFGVGYNHIDAGAAKEAGIVVTNTPGVLTDCTADLAVSLLLAAARRTGEGERQVRAGAWDGWRPTHMIGTKVTGKTLGIIGFGRIGKAMAKRCHFGFDMDIVFYNRSRVAPEEAARFGARQLDTVEDVLRAADFVSLHCPGGGENRHLINAARLAAMKPAAYLINTSRGDVVDEAALIAALEKGVIRGAGLDVYEAEPDVPTRLRALENVVLLPHLGSATEETRTAMGMKVVDNITAFFAGLQPPDRVA

SEQ ID NO: 11618 - protein, 352 aa, Sinorhizobium meliloti
MAWDEQKLNELKAKYGESHGGELFDPTFRKVADKIFTKSGTRLAPYSGIPTFLTAPHMPVDADDPDFGNLQVAMIGVPMDLGVTNRPGSRFGPRALRAIERIGPYNHVLGCAPVHDLRVADIGDVPFRSRYRLEISHEDIEKRISQIVDAGVLPLSVGGDHSITHPILKAVGRKQPVGMIHIDAHCDTGGAFDLTKFHHGGPFRNAVLDGVLDPTRVIQIGIRGSAEYLWEFSYESGMTVIHAEEVTGLGIPAIIEKAKKIVGDGPTYLSFDVDSLDPSFAPGTGTPEVGGLTTREVLELIRGLKGVNLVGGDVVEVAPQYDTTTNTAHAGAQVLFEILSLMVFSPAVAGKG

SEQ ID NO: 11619 - protein, 477 aa, Sinorhizobium meliloti
MLDKRKFYIDGKWVEPATQNDLLVLNPATEKPIAVISLGTAVDVDRAVAAAKKAFASYSRTSVEERLALLEKLLAIYKRRYDEMADTITAELGAPRTMSHEQQADVGVGHLQGFIDALKRLKLREKLPNGDTLLREPIGVCGLITPWNWPVNQIALKVVPALATGCTCVLKPSEFTPLNAMLYAEMIEEAGFPAGVFNLVNGDGIHAGAALSKHKDIDMMSFTGSTRAGIAVSKDAADTVKRVTLELGGKSPNIVFADADIEERVTASILECFNNSGQSCDAPTRMLVERSAYDEVVEIARRVGMEARVGDPTKVGSHIGPLVSHIQFERVQALIEAGVAEGATLLAGGPGKPEGFETGYFVQPTIFADVDNSMRIAREEVFGPVLSIIPFDTEEEAIAIANDTNYGLAAYVQTRDRERAERVASRLRAGMVHINGGPHRYGSPFGGYKQSGNGREGGMFGLEDFLEVKTVHLPDAA

SEQ ID NO: 11620 - protein, 455 aa, Sinorhizobium meliloti
MSIDADDPEVFQSWLEQNGPIESIQAVICDLNGIMRGKRVPVEQARKVLGGGIRMPLSIVGVDVWGEDIIGSAQVFATGDRDGICGVTGRGALPVNWTSRPSALVPLWLFVENGRPFLADPRQALAAIMREYRELGLRPVVATELEFYLIDPEPDSAVPPISPYTGKRLDSDAILSIDELDDFGEFFSDVYRECARQNVPADAAIAENGIGQFEINLLHSDDPLKAADDAIFFKRIVKGVARKHGLAATFMAKPYGTRSGNGMHVHFSLLDEEGNNVFDDGSDEGSAVLKHAVAGLLRGMAETTLMFAPHFNSYRRLRPDTHAPTSISWGYENRTSAIRIPGGNPAARRIEHRVAGADANPYLVIAAILGAALVGIRNKWKPPVPVEGRAYAAEKLPKIPADWGQAVDAFEAGPIAAEIFDPVLRSMLIACKRQEIAGFAEQVTDYEFSAYLEIV

SEQ ID NO: 11621 - protein, 409 aa, Sinorhizobium meliloti
MMPERIVIVGGGQAGGRVAQILAGSPANLDIALIGLEPHPPYNRPPLSKGVLLGKSELKDCVIWPQGDATAGRVRFYPGRRAESLDIHARHVITDDGARLDYDKLVLATGSRVRRLSVPGAECDGVFTLRTFDDAVAIARRFHRSKRLLVVGGGFVGLEIAAAARSRGLETVVVEATNRLLSRIVPQEIGAALARYHEAAGVSFRVGSMVEKLVANRSGKLKSAVLSNGETVPCDLAVIGVGVTANTELAKEAGLEVQVGIRTDSALRASADGVYACGDAVSFWHPLFERYVRVEAWQNAEDHARVVASQLLGQDMVCDTVPFFWSDQYEWSMQIAGIPYFGSQLVTNTVEEAKILYHLDARGRLVAATGLGHDRLIGRKIAEARRLIKRRARPNPQMLKTGQIQLEDG

SEQ ID NO: 11622 - protein, 420 aa, Sinorhizobium meliloti
MRPRRGPVHQENMVIVGCGHAGARAAQALRTNGWHGGITLVDGEGRTPYERPPLSKAVLKGESEAEDAPLFPADFLAKNDIHVLKGVAAAAIDRPTRQLRLSDGGSIAYHRLLLATGAEPRNLIVPGADLPGSHTLRSADDAARIFPYLRPGAEIVIVGGGLIGLEAAASATVRGCKVTVVEAGPRPMMRAVPAELSHEVRLFHESKDVRFVLGRQVSELEGDGRVRCVRLDDGTVLPCTAVVISVGVSPRTALAEAAGLEIDNGIAVDRFLRTSDPFIYAAGDACAFEQVSGPRMRLECWKNAEDQGTLAGRNMLGSDEAYVPLPWMWSDQFDRTMQIAGQAGGSAEDVRRRCPDSTLLIYHLDKDQMILGISGFGSIREVSRGVRMGQLLMERGIRPGRKALADPEFDLRSLAKAAVA

SEQ ID NO: 11623 - protein, 437 aa, Sinorhizobium meliloti
MPGLYARESRSVSKMAHLRFFPQAVVGGSGAYLTADDGRQLLDFSASWGAASLGHSHPAIREAVGRALSDQAGASYLSSANEACVLLAEKLLSLVPERARGRVWFGHSGSDANETVARIVVAATGRPRILAFHGAYHGGTIGSMGVSGHPAQQGSRAEGLTLVPYPNSYAAGSPEAARDAALAHLERLFATEVPPEEVAAFFIEPIQSDGGMLVPPDGFFKAVEALCRRHGILIVSDEVKVGLGRSGRFNAFEHSGIEPDIVVFGKGLGGGLPISAVVGPEAIMNHSVAFSLQTVHGNPVCAAAALAVLQTIERDHLILNADRSGKVLREALDRLTARHTLIGDVRGRGLALGIELVTDPASREPASRQAALTVYRAFQLGLVLYYVGVQSNVLELTPPLTLTPAEAESGVAMLGQALADVAAGRIDEALLGDFAGW

SEQ ID NO: 11624 - protein, 191 aa, Sinorhizobium meliloti
MFFLANGETRMPVVRGKNIEVLYSAETIAARNQEMAADIVRGPHKDLLVISILKGSFIFAADLIRAMHAAGLAPEVEFITLSSYGTGTESKGVRITKDIDSDVRDRDVLLIDDILESGRTLRFAKELLLERGARNVTIAVLLDKRVKRRVDLEADYVGFECPDHFVVGYGMDVAYAFRELPFVGVVTGDAT

SEQ ID NO: 11625 - protein, 347 aa, Sinorhizobium meliloti
MAIARGYAATDASKPLAPFTFERREPRDDDVVIDIKYCGVCHSDIHQARDEWGNSTFPMVPGHEIVGIVRAVGSQVTRFKIGDRVGVGCFVDSCTTCAKRDLDLEQYLPGLVVTYNGVEADGTPTQGGYSDHIVVKEGYVLSIPENLPLDAAAPLLCAGITLYSPLRHWKAGPGKKVAIVGLGGLGHMGVKLAHAMGAEVTVLSQTLSKKEDGLKLGADHYYATKDPETFTKLAGSFDLIICTVAAEIDWNAYLNLLKVDGELVLVGIPENPVPVHAFSLVPARRSISGSMIGSIKETQEMLDFCGEHGIVSEIETIRMEQINEAYERVVRSDVRYRFVIDMESIKA

SEQ ID NO: 11626 - protein, 399 aa, Sinorhizobium meliloti
MTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 11627 - protein, 341 aa, Sinorhizobium meliloti
MSERLEDIAVAMVANGRGLLAADESTATIKKRFDSIGLESTETSRRDYREMLLRSDDAMREYISGVILYEETLFQKAADGTPLADVIRNAGSIPGIKVDTGAKPMAHFPNETITEGLDGLAARLARYHEAGARFAKWRGVIAISDALPTWGAIRANAHALARYAALCQEAKIVPIVEPEVLMDGAPGDHSIERSEEVTEWVLRTVFEELGELRVRLEGMILKPSMVIDGKKARKASVDEVAERTIKVLKRTVPAAVPGIAFLSGGQSTEEATAHLSAMNAAHDLPWKLTFSYGRALQQEALNAWGGKSENVAAGQRAFAHRAKMCSLAAKGSWTKDFEKAA

SEQ ID NO: 11628 - protein, 479 aa, Sinorhizobium meliloti
MRRNRKVKILATLGPASADEQMIQKLHEAGADLFRINMSHASHEVMRTLIERIRVVEARCGRPIGILADLQGPKLRVGKFAEGKVELKIGQTFTLDNRDVPGDSRRVYLPHPEILEAVKPGHRLLIDDGKLHLRAEKTDGKSIVTTVVSGTRISDRKGVSLPDTLLGVGALTDKDRVDLDAVLATGEVDWVALSFIQRPEDLAEVRKIARGRVGLMSKIEKPQAIERIDEIIELSDALMVARGDLGVEMPLESVPGLQKQLTRACRRAGKPVVVATQMLESMISSPVPTRAEVSDVATAVFEGADAVMLSAESASGEYPVEAVSTMASIASNVERDPHYPGIIYAQRTPPEATGADAISLAAHQIAETLKLAAIVTYTSSGTTGLRAARERPQVPVIALSPIVQTARRLSVVWGLHCVVTEDATDLDDMVNRACRIVSTEGFGKPGDRIIVTAGVPLGTPGATNMLRIAYIGSDGQSGI

SEQ ID NO: 11629 - protein, 478 aa, Sinorhizobium meliloti
MEIDRQVAKYQPASDRIRHFREFTIPMSDQEVQKQSARCMDCGIPYCHGPTGCPVHNQIPDWNDLVYNGNWDEAIRNLHSTNNFPEFTGRVCPAPCEEACTLNLEDVPVAIKTIEQAIADKAYEMGYIVPQPAVTKTGKKVAVIGSGPAGMAAAQQLARAGHEVHVYERESKPGGLLRYGIPDFKMEKNFIDRRVEQMRGEGVTFHCGVNVGVDVAVQKLVDENDAVLYCGGSETPRDAGIPGVEFFGVHDAMPYLVQQNRRVGRENIDSVGWPSEPILAGGKHVVVVGGGDTASDCVGTAFRQGAVKVTQLDIRPQPPEKEDKLAVWPFWATKMRTSSSQAEGAVREFQVATLEFVGDEDGNLTGVKCCQVDERRKPIAGTEFIIKADLAFIAIGFRGPFADSVLKDLGEKLTVNTDRRGSTNVVANERDYRTSVDKLWAAGDIRRGQSLVVWAIREGRQAARAIDEALMGSTVLPR

SEQ ID NO: 11630 - protein, 391 aa, Sinorhizobium meliloti
MAKFCRSNRDSETGGASLKTPAAVLRKSPVERPYAHTRPLSIETIDLAPPGPDELLVKIGAAGLCHSDLSVINGDRPRPVPMALGHEAAGTVEAVGSGVRDISPGDRVVMSFMPSCGHCLPCAEGRPALCVPGAEANGKGTLLSGERRLSCGEVPVNHHLGVSGFADYAVVSRHSAVRIEADLPMVEAALFGCAVLTGVGAVVNTCRVRPGESIAVVGLGGVGLAALLGAIAAGAERIVAIDLAEDKLKLARALGATDTFLAADPDAAENIRQATRGGVDHAIEAAGSVRAFDLAYRITQRGGLTVSAGLAHPSSQISIPAVSLVAEERSVRGSYMGSCVPARDIPRFIALYERGRLPVDRLLSSTGPLEEINEAFDLLDQGRVIRHVITF

SEQ ID NO: 11631 - protein, 458 aa, Sinorhizobium meliloti
MMIEAKKLAARFPGDFVFGVATASFQIEGASKADGRKASIWDAFSNMPGRVYGRHNGDVACDHYNRLEQDLDLIKSLGVEAYRFSIAWPRIVPEGTGPINEKGLDFYDRLVDGLKARGIKAFATLYHWDLPLALMGDGGWTARTTAYAYQRYAKTVIARLGDRLDAVATFNEPWCSVWLGHLYGVHAPGERNMDAALAALHFTNLAHGLGVAAIRSERPELPVGIVINAHSVYPGSNSAEDKAAAERAFDFHNGVFFDPIFKGEYPEDFLSALGERMPAIEDGDMATIAQPLDWWGLNYYTPMRVSADPAKGAEYPATVNAKPVSNVKTDIGWEVYAPALGSLVETLNARYRLPDCYITENGACYNMGVENGTVDDQPRLDYISDHLAVTADLIAKGYPMRGYFAWSLMDNFEWAEGYRMRFGIVHVDYETQVRTIKKSGRWYKDLAERFPSGNHKPG

SEQ ID NO: 11632 - protein, 464 aa, Sinorhizobium meliloti
MKEISCKLLVLGAGPGGYVAAIRAGQLGVNTVIVEKAKAGGTCLNVGCIPSKALIHAADEYHRLRAAASGKGPLGLSLSAPAIDLRRTIAWKDGIVGRLNGGVTGLLKKAGVKAVIGEGRFVDGKTVDVETETGLQRIRAEAIVIATGSAPVELPDLPFGGSVISSTQALALTDVPQTLAVIGGGYIGLELGTAFAKLGSKVTVLEALDRILPQYDADLSKPVMKRLGELGVEVFTRTAAKRLSADRRGLLAEENGRAFEVPAEKVLVTVGRRPVTDGWGLEEIDLDHSGRFIRIDDQCRTSMRGVYAIGDVTGEPMLAHRAMAQGEMVAEIVAGHKRSWDKRCIPAVCFTDPEIVGAGLSPEEARAAGIDVKIGQFPFQANGRAMTTLSEDGFVRVIARADNHLVLGIQAVGHGVSELSATFALAIEMGARLEDIAGTIHAHPTQSEAFQEAALKTLGHALHI

SEQ ID NO: 11633 - protein, 307 aa, Sinorhizobium meliloti
MKTITLIGAPIEEGSGRRGAAMGPTALRIAGIDTVLAELGHTVNDEGDLRPLPARDLANHPGANNLQSVAAFARALDEAVHDTARKGHFPIILGGDHALSMGSVSGMARHAQDVGRPLFVLWLDAHADFNSPATSPSGNMHGMPVAFFCGEAEFAPILPKDRPLVDPKKVYQVGIRSVDAREREEIAEHGVNVFDMRAIDEMGMAHIIRQIVDEVRAANGLLHVSLDVDFMDPELAPGVGTTVPGGATFREAHLIMEVLCDSGLVSSLDVVELNPFLDDRGKSARILVELTASLFGRRILDRPTRAA

SEQ ID NO: 11634 - protein, 468 aa, Sinorhizobium meliloti
MAYDLIVIGSGPGGYVCAIKAAQLGMKVAVVEKRSTYGGTCLNVGCIPSKALLHASEMFHQAQHGLEALGVEVANPKLNLQKMMAHKDATVKSNVDGVSFLFKKNKIDGFQGTGKVLGQGKVSVTNEKGEEQVLEAKNVVIATGSDVAGIPGVEVAFDEKTIVSSTGALALEKVPASMIVVGGGVIGLELGSVWARLGAKVTVVEFLDTILGGMDGEVAKQLQRMLTKQGIDFKLGAKVTGAVKSGDGAKVTFEPVKGGEATTLDAEVVLIATGRKPSTDGLGLAKAGVVLDSRGRVEIDRHFQTSIAGVYAIGDVVRGPMLAHKAEDEGVAVAEIIAGQAGHVNYDVIPGVVYTQPEVASVGKTEEELKAAGVAYKIGKFPFTANGRARAMLQTDGFVKILADKETDRVLGGHIIGFGAGEMIHEIAVLMEFGGSSEDLGRTCHAHPTMSEAVKEAALSTFFKPIHM

SEQ ID NO: 11635 - protein, 356 aa, Sinorhizobium meliloti
MASVELRDIRKSYAALEVVHGVSLSIAEGEFIALVGPSGCGKSTLLRMIAGLEEISDGEVLIGGKVVNPLTPRERNIAMVFQSYALYPHMSVAENMGFNLKLSGLSRPEIDKKVGEAARMLALTELLDRKPSQLSGGQRQRAAMGRAIVRDPAVFLFDEPLSNLDAKLRVQMRTEIKALHQKVATTSIYVTHDQIEAMTLADRIVVLNGGRIEQVGTPLELYRTPANLFVAGFIGSPAMNVLDGTVDADDGEPAVRLGDGSAIRIAPERKVRPGQAVRIGLRPEHFVAGGEGNAIAGQTLLVEPTGAQTHVLFEFAGEQITAVVDGDHPARHGSLFRAAMDRSQVYVFDRQTGAAL

SEQ ID NO: 11636 - protein, 167 aa, Sinorhizobium meliloti
MTAEDLPYRPCVGVMVLNRQGLVWAGHRLAVGNSEYDGSPQLWQMPQGGIDEGEDPLEAACRELYEETGIRSVSLLAEAPDWIHYDLPSHLIGIGLKGKYRGQRQRWYAFRFEGDESEIAINPPPGGHEPEFDAWEWKPMHELPGSIVPFKRRAYEEVVAAFSHLVR

SEQ ID NO: 11637 - protein, 445 aa, Sinorhizobium meliloti
MNAHNKPNAPVLDSYWMPFTANRQFKAAPRLLAAAEGMHYTSVDGRTVLDGTAGLWCVNAGHGRRQIAAAVERQLSTMDFAPSFQMGHPIAFDFAERLAEIAPGPAGAKLDRVFFTGSGSESVDTALKMALAYQRSIGQGTRTRLIGRERGYHGVGFGGISVGGIVNNRRVFPQLPGSDHLRHTHDPAKNAFVKGQPEHGAELADDLERLVALHGAETIAACIVEPVAGSTGVLIPPKGYLERLRAICDKHGILLIFDEVITGFGRLGAAFATDYFGVTPDIVTTAKGLTNGAIPMGAVFASRKVHDALMHGPEGQIELFHGYTYSGHPAACAAGIATLDIYRDEGLMTRAAEIEGDWHEAMHSMKGLPHVIDIRTIGLIAGIELQSRDGAPGARAYDVFVDCFERGLLIRVTGDIIAFSPPLIAEKQHFGEIVSILADALKRVK

SEQ ID NO: 11638 - protein, 504 aa, Sinorhizobium meliloti
MVMTVVVRPKALGDYDTREFRMLIDGQWVDGAEGRTIERVAPGHGVVVSRYQAAAKADAERAIAAARRAFDEGPWPRMTASERSLILLRAADMIAARADELAFLDAVESGKPISQAKGELAGAADIWRYAAALARELSGESYNTLGEGTLGVVLREPIGVVSIITPWNFPFLIVSQKLPFALAAGCTTVVKPSELTSASTLVLGEILEAAGVPQGVVNIIVGTGPEAGAPLTTHPHVDMVSFTGSTGIGQLTMANAAQTLKKVSLELGGKNPQIVFPDANLDEFIDAAVFGAYFNAGECCNAGSRLILHRDIAEEVTARIASLSAKVKVGDPLDPETQVGAIITPQHLQKIAGYVSSASNEGARIAHGGTTLDLGMGQFMAPTILSAVRPEMAVAREEVFGPVLSVLTFEKTEEAIRIANSIDYGLSAGVWSRDFDTCLTIGRRVRAGTVWMNTFMDGASELPFGGYRQSGLGRELGRHAVEDYTETKTLNMHIGRRSNWWMPR

SEQ ID NO: 11639 - protein, 506 aa, Halomonas salina
MIYANPGSPESVVSFDARYGNYIGGEFVPPVKGQYFDNVSPVNGKPFCEIPRSTAEDIDKALDAAHAAAPAWGKTSAAERGNILLRIADRIEQNLELLAVAETWDNGKAVRETLNADLPLAVDHFRYFAGCIRAQEGTAADIDANTVAYHFHEPLGVVGQIIPWNFPILMAVWKLAPALAAGNCVVLKPAEQTPASILKLMELVGDLLPPGVVNVVNGYGAEAGQALATSTRIAKIAFTGSTPVGSHILKCAAENIIPSTVELGGKSPNIYFADIMDAEPEFIDKAAEGLVLAFFNQGEVCTCPSRALIQEDIYDAFMAKVMEKVATITRGNPLDTDVKVGAQASQEQFDKIMSYMEVAREEGAEFLTGGDKEHFDPAYDSGYYIQPTLLKGHNKMRVFQEEIFGPVVAVTTFKDEEEALAIANDTEFGLGAGVWSRDINVAFRMGRGIQAGRVWTNCYHQYPAHAAFGGYKKSGVGRETHKVALEHYQQTKNLLVSYDTNPLGFF

SEQ ID NO: 11640 - protein, 118 aa, Oryza sativa (japonica cultivar-group)
RIQNPLAQTKTQDLILNYIIQLCDKFPSPMEDSSVDCASLASMPEISFTIEAKKFALKPEEYILKVGKEAAAQCISGFTAMDIPPPRGPLWILGDVFMGAYHTVFDYGKMRVGFAKSA

SEQ ID NO: 11641 - protein, 440 aa, Myxococcus xanthus
MGATVYAGGTTFRVWAPMASRVFVSGDFNGWGTWIELGNEFNGNFSGDVAGAVKGQKYKFITRNQWGSDAWRADPRSAWQENSTGSSIIYDHGEYWWNAQQYSSPGFNEMIIYEMHVGTFHDSPGFGPGNWNSAIARLDHVRDLGANMIKVMPAYEFAGDFSWGYNAAFPFAPESAYGHPNDMKRFVDEAHMRGIGVIFDVVHNHYGPSDLPMWCFSGDCLGSGGEYFYNDWRKSTPWGDTRPDYGRPEVRAYIRDSMMNLTHSFRGDGLRWDATKYMRTQNGSDTTAIPDAWRVFRSINREINATQPWKISIAEDFGGGDFITNDATSDTSGGAGFDSQWGGDFVHAIRAAVIASNDSGRDMNSVRNAITQRYSGRHTARVIYSESHDEVANGKARVPEEIWPGNAGSWAAKKRSTLAAGVVFTSPGIPMIFQGQEFLE

SEQ ID NO: 11642 - protein, 481 aa, Salmonella enterica
MSQCLYPVVIAGGTGSRLWPLSRVLYPKQFLNLVGNSTMLQTTIARLNGIKCENPIVICNEDHRFIVAEQLRQIDKLTKNIILEPKGRNTAPAIALAAFIAQKKKPKDDPLLLVLAADHSINNEQAFREAIIKAIPYADAGKLVMFGIIPSVAHTGYGYIKRSVPVDADKDSTAYYVANFVEKPNIQKAQEYIMSEGYYWNSGMFLFRASKYLGELKKFRPDIYNKCESATATANIDMDFVRINETEFINCPEESIDYAVMEKTKDAVVLPIDVGWSDVGSWSSLWDISQKDVHGNVCQGDVINHDSEDSFIYSESSLVATVGVSNLVIVQTKDAVLVADRDKVQNVKNIVDSLKQGGRAEYYMHREVFRPWGKYDAIDQGDRYKVKKIIVKPGEGLDLRMHHHRAEHWIVVSGTAKVSLGNKIKLLVPNESIYIPQGAEYSLENPGVIPLHLIEVSSGDYLESDDIVRFTDRYNSKKFLK

SEQ ID NO: 11643 - protein, 358 aa, Neurospora crassa
MAEFIRAQIFGTTFEITSRYSDLQPVGMGAFGLVCSAKDQLTNQNVAIKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMMYSEILDYHNVEASGQMMFQEDVPPQ

SEQ ID NO: 11644 - protein, 330 aa, Streptomyces viridochromogenes
MRYRTLGRQGPEVSSVCLGTWALSGFWGSRTEPAVEAVRRAFDLGVNFFDTAHAYGAGMAEAGLARGLGDLLRTRRSDIVISTKGGLELRGDGVVRNSDAGFLRANLTDSLRSLGTDYVDVFLVHWPDPRVPPAETAGALAGFVEEGLARYVGVSNFTVEEMAEFSSVVTPQVAQVPFNMLDRGIEKQVLPHCAAAGIGVMGWSALAHGVLAGALRPGQVFPPDDWRAYSPTFQGERFAKLLAAVDRLKEFAAERGHSVAQLALAWVLAHPSGVIPVIGAQLPEHLEDSVRAVDLDLDEAELRALDELLADAPELDGSGDQPPAREERSV

SEQ ID NO: 11645 - protein, 245 aa, Vibrio harveyi
MIKLENIHKRFGDTEVLKGIDLDIKQGEIIVIIGSSGTGKSTLLRTVNFLEQADEGRITIDDISVDTQKHTKAEVLALRRRTGFVFQNYALFAHMNARQNIAEGLITVRGWKKDDALKRAQQILDDIGLGDKGESYPAALSGGQQQRVGIGRAMALQPELLLFDEPTSALDPEWVGEVLSLMKKLANQHQTMLVVTHEMQFAKEVADRVIFMAEGNIVEQGSPQDIFDNPQDPRLKKFLNQVGIE

SEQ ID NO: 11646 - protein, 153 aa, Arabidopsis thaliana
MAPFPLSLIFGKKKRRRDDEIRRQKPTLKGVMTAFFATEAAICLLLLAGISLTGTAVALFASMPLFLVFSPVLVPAGIATTILASGLMAGGTSGVSGLTILMWLYKKYTGRDFPIKIPGAAAAGGAAPAAPAAPAPAAPAVKPAAKPAAKPGA

SEQ ID NO: 11647 - protein, 147 aa, Arabidopsis thaliana
MAPFPLSLISGKKKRRRDDEIRRQKPTLKGGMTAFFATEAAICLLLLAGISLTGTAVALFASMPLFLVFSPVLVPAGIATTILASGLMAGGTSGVSGLTILMWLYKKYTGRDFPIKIPGAAAAGGAAPAPAAPAAKPAAKPAAKPGA

SEQ ID NO: 11648 - protein, 149 aa, Arabidopsis thaliana
MAPFPLSLIFGKKKRRRDDEIRRQKPTLKGVMTAFFATEAAICLLLLAGISLTGTAVALFASMPLFLVFSPVLVPAGIATTILASGLMAGGTSGVSGLTILMWLYKKYTGRDFPIKIPGAAAAGGAAPAAPAAPAPAAPAAKPAAKPGA

SEQ ID NO: 11649 - protein, 444 aa, Vitis vinifera
MSLQRRFVPCLIVFLLSFPCYFSLQASPPYDYLGEASGYDSQANHLHFSTIQSRETENWPWRKFGSKTGKSLASVKMVNVNYYGAKGDGSDATEAFKKAWKAACSSPGSVLVVPKNKNYLLKPITFQGPCKSSITVQIYGTVQASTDRSAYSNDMTHWLIFENVQNLAVQGGGTINGNGKTWWENSCKVNYDLPCKGAPTALTFYNCKNLAVKNLKIQNAQQMHVSFEKCVGVQASGLTITAPGNSPNTDGIHVSYTKIIQISSSVIGTGDDCISIVSGSQKVQVNGITCGPGHGISIGSLGSGDSEAHVSDVTVNGATLSGTTNGVRIKTWQGGSGSASNIKFQNIVMHNVENPIIIDQKYCDQSKPCKSQSSAVQVQNVLYQNIKGTSSSKEAISLDCSAKFPCQGILLRDIDIKVGGGKAAKAVCSNARVTVMGDVSPNCA

SEQ ID NO: 11650 - protein, 143 aa, Vitis vinifera
VNVHIANGACITVQFVTNVIIHGLHIHDCKPTGNAMVRSSPSHFGWRTMADGDAISIFGSSHIWVDHNSLSSCADGLVDAVMGSTAITISNNHFAHHNEVMLLGHSDSYERDKQMQVTIAYNHFGEGLIQRMPRCRHGYFHVV

SEQ ID NO: 11651 - protein, 152 aa, Apium graveolens
AIMFYAPVLFSTLGFKDNASLYSAVITGAVNVLSTVVSIYVVDKLGRRILLLEAGVQMFIAQIIIAIVLGIKVTDHSDNLGTAYAVIVVVMICTFVSAFAWSWGPLGWLIPSETFPLETRSAGRSVTVCVNLLFTFVIAQAFLSMLCHFKFG

SEQ ID NO: 11652 - protein, 472 aa, Alniphyllum fortunei
QTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11653 - protein, 470 aa, Bruinsmia styracoides
  misc_feature (442)..(442): Xaa can be any naturally occurring amino acid
ETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIRXASKWSPELAAACEVWKEIKFEFEAMDTL

SEQ ID NO: 11654 - protein, 466 aa, Huodendron biaristatum
SVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELAVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRTRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11655 - protein, 471 aa, Melliodendron xylocarpum
PETKASVGFKAGVKDYKLTYYTPEYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11656 - protein, 404 aa, Mycoplasma capricolum subsp. capricolum
MNYNNKKTLKDIDVKNKTVLVRVDFNVPIQNGVITDDNRIIAALPTINYLIENDAKIVLFSHLSRIKTNEDKLKKSLAPVAKRLEELLNKKVKFINQTRGKELEQAVSLLQTKEIILVENTRFEDVLDDQVVKYESKNDPELGKYWASLGEVFVNDAFGTAHRSHASNVGIASNIKISAIGFLVEKELKMLSQAVNDSKKPFIAILGGAKVSDKIGVIENLLPKVDKLLIGGGMSYTFLKAQGRSIGKSLLEEDKIDLAKHYLEVGKDKIVLPVDTACAKEFADVKPTIFETNIPDEWDGLDAGPKTIEMYKEEIKKAKTIVWNGPVGVFEFKNFETGTKSICQAIAEQTKTGAFTLIGGGDSASAAINMGFKDNFSWISTGGGASLEFMEGKELRGISAIQNK

SEQ ID NO: 11657 - protein, 258 aa, Pseudomonas putida
MTAEGFLEGRRLQMARGVLLQCIMGGYPPAKFYGCDDGDLALVAEPSQVHRLPWSDDGRALAICDANELDGRPSALSTRGQLKAVIARYAALGLAPVVATELEFFVFAPNSDPQQPFQPPLGTDGRRELGHSAFSVSSNNGLRPFFNEVYQCMAALGLPRDTFMHEMGVSQFEINLLHGDPLLLADQTFLFKHLLKEVALKHGLTVVCMAKPLARTPGSSMHIHQSLVDTGSGRNVFSDEQGQPTDTFHHFIGGLQAC

SEQ ID NO: 11658 - protein, 175 aa, Zea mays
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 11659 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 11660 - protein, 245 aa, Mycobacterium tuberculosis H37Rv
MRVGVLGAKGKVGTTMVRAVAAADDLTLSAELDAGDPLSLLTDGNTEVVIDFTHPDVVMGNLEFLIDNGIHAVVGTTGFTAERFQQVESWLVAKPNTSVLIAPNFAIGAVLSMHFAKQAARFFDSAEVIELHHPHKADAPSGTAARTAKLIAEARKGLPPNPDATSTSLPGARGADVDGIPVHAVRLAGLVAHQEVLFGTEGETLTIRHDSLDRTSFVPGVLLAVRRIAERPGLTVGLEPLLDLH

SEQ ID NO: 11661 - protein, 478 aa, Pseudomonas fluorescens
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 11662 - protein, 409 aa, Sinorhizobium meliloti 1021
MPNTPWSATSQNLGQDFHNWSGGLRFRPSRLDVPEDEETVAALVRAAARQGRSIRPVGSAHSSSEIYVTDDILVSMAGICGLREHDAQHHRATVGAGSQLTELSKELQAAGMTLSNFGDVATQTVGGAIGTGTHGSGRDFPNLSMMLVGGRLVTAGGEIRTFDVEEEPDFVRALRVSFGTLGILTWTTLKLEPLHDLHRQEWCLAFEPCMEVLDKLSRENRNFDFYWYPRSDEVKIRCLNPPGEEKDYGAFARLAKDETGPPHEVIPQHSDLPHRFEEMEYSMPAEAGPECLGKLRARIKERWRRSVGWRLLFRYIKADDSWLSEAYGRDSVSISLHQNATLPYWDFFLDLEPIMRDHGGRPHWAKKHSLRAAELRPLYPMWDRFLALRQEMDPGGRFLTRYLRGLLGC

SEQ ID NO: 11663 - protein, 375 aa, Sinorhizobium meliloti 1021
MRTRAALAVQAGKPLVVTEVELEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 11664 - protein, 228 aa, Sinorhizobium meliloti 1021
MNEKTIIAPSVLSADFSRLGEEVEAVCRAGADWIHLDVMDGHFVPNITFGPPVIKALRDRTDKVFDCHLMIEPPTPYLGAFACAGCDIITVHAEATTHLDRSLQAIRDVGCKAGVSLNPSTPESVIEYVLDRLDLVLLMTVNPGFGGQDFIPAVVDKVRRVRSMIGGRPIHIEIDGGVTPETAPLVAAAGADVLVAGSAVFKGGSEEHYARNIAAIRAASDGAIRKAA

SEQ ID NO: 11665 - protein, 447 aa, Sinorhizobium meliloti 1021
MTHLLHRAIHAKLPVAVRGEGIRLFDAEGRAYIDASGGAAVSCLGHAHPDVLAALHAQLDRIAYAHTGFFTTEAAERLADRLVADAPDGLDHVYLVSGGSEAVEAALKMARQYFVEKGEPQRRHIIARRQSYHGNTLGALAAGGNEWRRAQFRPLLVETHHIDPCFAYRLQQAGESDTDYAARAAGQLEAKILELGADQVIAFVAETVVGATAGAVPPVADYLKRVRAICDKYGVLLILDEVMCGMGRTGTLHACEQDGVVPDLMTIAKGLGGGYQPVGAVLLSSAIFQAFSEGSGFFQHGHTYMGHPMAAAAGLAVQEVIRRDGLLENVVSMGDYLERCLVERLGNHHHVGDIRGRGLFRAVELVADRATKSPFDPGLKLNARIKKEAMARGLMVYPMGGTIDGQRGDHVLLAPPFILNREDVGQIVERLGDAVDAAIASLTKAAG

SEQ ID NO: 11666 - protein, 487 aa, Sinorhizobium meliloti 1021
MNPETTAVPYERLGILIDGRWIYEAERSTEVVDPATGQTIARLPFAADGEIAEAVASSQRAFESWKDRSPLERGRILRRFADLARKHADEIARNMTRDQGKPLSEAIGEIRFAADHADWHAEEARRIYGRVIPARDPRVQQMVLREPVGVCIAFTPWNFPFSQALRKVVAALASGCTIILKGPGESPSSTVAIGRLMQEAGLPDGCLNILWGDPAHLSETLLAAPEVRKISFTGSVEVGKHLASLAGRHMKRSTMELGGHAPVILFDDADIEAAADALAGQKVRNAGQVCISPTRFYVQAKGHDRFLARFAEKIASTRVGNGFQESVQMGPLCHGRRVAAMEGFIQDAREQGAEIVTGGERVGNAGFFYAPTVVAAGTDELRLMKEEPFGPIAVVTPFGDFDEVIRRANSLPFGLASYVFTGSSSRAQNAARALAAGMVSVNHFGLALPETPFGGINDSGYGSEGGSETFDGYLNTKFVTRFDQIPQ

SEQ ID NO: 11667 - protein, 461 aa, Sinorhizobium meliloti 1021
MNDRPNSLHALDKQSLVHPYTNLAVHQETGPHVITGGDGIYVVDDEGKRYIEGLAGLFCAGLGFSEQRLVEAATRQLKTMPFYHSFAHKSTEPGIRLAEKLLSIAPVPMSKVFFAGSGSEANDTAIKLIWYYNNALGRPEKKKIISRRKAYHGVTVATASLTGLPFNHRDFDLPIANILHTDCPHYWRFAETGETEEDFATRMANNLEAIILEEGPETIAAFFAEPVMVSGGVITPPKTYFEKVQAVLRKYDILLIADEVICGFGRTGNMFGSETYGLKPDMISCAKQLSAAYMPISALMINAKIADALVDQSRKIGTFSHGFTYGGHPVAAAVALEALTIYEEIDIVGHVRSVAPAFQDRVRKLGEHPLIGEARGVGLVAGLEFVKDKATRENFPPAWQVANQAGKFATARGVLTRGLGDMVSLCPAMIIDDEQIDDLMTRMGLALDDTLAWARAQGHVG

SEQ ID NO: 11668 - protein, 326 aa, Sinorhizobium meliloti 1021
MRAAWYGKNGAARDVLEVGGLPDPLPGPGEVRVRIHASGVNPSDVKARAGRPLIAPRMIPHSDGAGIIDAVGTGVAGERIGERVWTWNAAWRRSNGTAAEYVVLPQDQAVHLPDNVSFEEGACLGIPALTALRAVTTDGGVFGKTVLVTGGAGAVGAYAIQFARLYGAACIITTVSSSEKAEICTRLGADHTINYRTEEVVDRIGGITHGRGVDRVIEVDAATNVAMLPGIIARDGLCVIYGSSKPVVSFEFFPMILAGAAARFFIVYEMSPEARTETVSALQGQLASGLLRHHIAGTYALDDIAAAHEAVESGKTIGNVVVSLGQ

SEQ ID NO: 11669 - protein, 359 aa, Sinorhizobium meliloti 1021
MRMMHSVPKTMTAVLLTGHGGLEKLVYSRDVPVPAPAAGEVLIKVTACGMNNTDVWVREGAYGTEDDPSAVSTWRRHGNTLTFPRIQGTDTVGHIVAVGEGVDRARIGERVMVDFSIYNRDDDSLADIDYMGHGRDGGYAEYMALPAENAHVVATDLTDIELATFCCAYLTGERMLERARLAAGETVLVTGASGGVGSAIIQLARARGAVPIAVAGPGKEAAMLDIGAQAVVTRGQGDLAEAVEAASGGRPIDVVADLVGGPLFNDLLKILRPEGRYTTAGAIAGPVVQLDLRTMYLKQLELHGSSQGSRADFRRLVRYIEEKKIRPLVGGVYPLSEFHRAQTDFMAKNFVGKLVVVPD

SEQ ID NO: 11670 - protein, 458 aa, Sinorhizobium meliloti 1021
MLERSNELTAWDRDHFFHPSTHMGMHARGETPTRVIGGGEGVYITDISGKRSLDAFAGLYCVNVGYGRQKIADAIAEQAKNLAYYHAYVGHGTEASIRLSKMIIDRAPEGMSRVYFGLSGSDANETNIKLIWYYNNILGRPEKKKIISRWRGYHGSGVMTGSLTGLHLFHNAFDLPRAPILHTEAPYYFRRPDRSMSEEQFSQYCADKLEEMILAEGPDTVAAFIGEPILGTGGIVPPPKGYWEKIQAVLQKYDILLVADEVVTGFGRLGTMFGSDHYGIKPDLITIAKGLTSAYAPLSGTIVSDKLWQVLVKGSDELGAIGHGWTYSAHPICAAAGIANLELIDELGIVENAGSTGAYFRAELQKAVGDHRHVGEVRGDGLMAAIEFVEDRDDRAFFDPGRKVGPQVAAALLERGVIGRAMPQGDILGFAPPLCLTRDEADIVVKAAADTIQSVLGR

SEQ ID NO: 11671 - protein, 498 aa, Sinorhizobium meliloti 1021
MTAVFARTAFHDALKNLSDRQLLRELAYVGGRWVAGRDGTCLEVSDPASGAALAFVASLDAAQTSEAIDAAQKAFRSWHNMLPQARAAILRKWHDLMLEAREDLALLMTLEQGKPLAESRGEIDYAASFIEWYAEEGKRLNAESVTSHLAGAEMIVRREALGVVGIVTPWNFPSAMITRKAAAALAAGCTVVAHPSSETPLSALALAELGERAGLPAGVFNVVTGKAATIVGRMCEDARVRAMSFTGSTEIGRLIASQCAPTMKRLVMELGGHAPLIVFADANVEKAADIAIAAKFATSGQDCLAANRIYVERPALKAFQEAFAARIAGLKVGSGMEPDTDIGPLMHERAVAKVEEQVADALKLGARLAVGGKRHAAGPLFFQPTLLTDVPDDALIMREETFGPVAAVTAFDSEEEVVARANDTEYGLVAYVVTENGARQMRLARALEYGMVAVNRVKITGGPIPFGGWKQSGLGREGSRHGMEAFTELKYLCIDTAA

SEQ ID NO: 11672 - protein, 424 aa, Sinorhizobium meliloti 1021
MSALHQTQSTYKGAPGRALWVSTGAFTVCFAIWTIFSIIGVRIKDELGLSEAEFGLLIGMPILTGSLVRIVLGIWTSRYGGRLVYTLTMLAAALATFLLAYATTYPQMLLAGLGVGLAGGSFAVGVAYVSPFFPPEKQGTALGIFGAGNVGAAVTKFLAPFVLVAFGWQAVAEVWAAALLVTAVVFWFSTEDDPQFRARRDVGAPRKSFLSEFEPLKNIQVWRFSLYYFFAFGGFVALALWLPRYLVGVYGFDIETAGMIAAAYSIPGSIFRAYGGALSDKLGARRIMYAMFAVSAVATAILSIPAGAAGGAMPILVTPIVFVVVTFVLGFVMSLGKAAVYKHIPVYYPSHVGAVGGIVGMMGGLGGFVLPIAFGFLKDVTGLWSSCFMLLFVIVAVSMVWMNVSIRQIKREADRGVPAGALAR

SEQ ID NO: 11673 - protein, 331 aa, Sinorhizobium meliloti 1021
MNGQQIMREIGRSGVAASAVGLGTWAIGGWMWGGTDERESVAAIQASLDAGVTLIDTAPAYGLGRAEEIVGKALSGRRDKAVIATKCGLVWHTQQGNHFFDQDGRPVHRHLGRESIFHEVEQSLRRLGTDYIDLYITHWQDPTTPIEETMRALEDLRAAGKIRAIGASNVNLEELQIYVQIGGLDAIQERFSMLDREIEAQLLPVTMANGVATLSYSSLALGLLSGSIGPERVFSGDDQRRNNPRFSVANREKVTRFAEAIRPIAQEYEGSIAQIVIAWTLAQPGITFALCGARNPAQALDNAGAGTIRLSAEALSAIDAAIAAELANMDR

SEQ ID NO: 11674 - protein, 409 aa, Sinorhizobium meliloti 1021
MTHIVIIGAGECGARAAFALREKGFGGEITLTGAEPHLPYERPPLSKDGLAQASLPKFIAGAARYEEARITVLTGVTAESIDRVHKAVTLSDGVSLDYDRLLLATGARPRAFPRVPENAGRIRTLRTHADALAIRGALTPGARLAVIGGGFIGLELAATARKLGAEVVLVEGLPRVLSRGVPEEIAVLVAERHRREGVEIICGAQIAAIDGAGDGARLLLADGVDIEADLIVVGIGAVPNTELAEAAGLAIENGIAVDERLCTSDPRHLCRPATAAPSLCPHYGGRRVRLEAWRNAQDQGALAAANLMGAGETMVSVPWFWSDQYEFTLQIAGLADGAETTVRRDMEEGAFILFHLDGEGRLIAASGIGPGNAVARDIRLAEMLIAAGAKPEPLALASPETRLKKLLAA

SEQ ID NO: 11675 - protein, 457 aa, Sinorhizobium meliloti 1021
MAGLLEEQHTRSLSFGCVEMTSAKGGKMFERLFKLKEHGTTVRTEVIAGVTTFLTMSYIIFVNPDILSTTGMDRNAIFVATCLAAALGSAVMALVANWPIGMAPGMGLNAFFAFTVVAALGFTWQQALGAVFISGIIFLFLTVTGVRSWLIAGIPHSLRSAIATGIGLFLGIIALKNAGIVVDNPATLVGLGDLKQTGPLLAILGFFVIAVLDALNVRGSILIGILVVTVLSMFLGVSEFQGIVSAPPSIAPTFLQLDIMGALHGGLVHVILVFVLVEVFDATGTLIGVAKRAKLVEEGKPSRLGRALLADSSAIVAGSLMGTSSTTAYVESASGVQAGGRTGLTALTISVLFLAALFISPLAAAVPSYATAPALLYVAGLMMRELTEIEWDDLTEAAPAALTAIAMPFTYSIANGLAFGFVSYVVLKVCTGKWNVIHPATQLVAALFIVRFAFFAE

SEQ ID NO: 11676 - protein, 326 aa, Sinorhizobium meliloti 1021
MKAIEFRRFGSPDVLQSVDVATPSPGRGEALVRVGAVGVNYFEVLMRQDRYAVTPELPMIPGVEVAGVVVAVGEDLSQDIIGSRVAVPMFAHGRGTGGYAEYVSVDAAMLVPIPDGLSFEAAVALMVQGLTALYLVRQSSLQNKTLLISAAAGGVGSLLVQLARDGGARTIVAVASSQKKLDSARGLGAHLGINYAAPDWTATLREALNGGGVDILYDFVGGEFTHAAIDLLVPAGELVFGALGRFALSGRQVESMFALNQSLRGFALLPLLNLAGLKADLTELFTRAQEGALTVAIDSRFSLDRAADAHRAIESRRTIGKVVLVP

SEQ ID NO: 11677 - protein, 473 aa, Sinorhizobium meliloti 1021
MWTTLPPGASISPEVVMNKHFDAVIIGAGQAGPSLAGRLSGVGKTVALIERKLFGGTCVNTGCMPTKAMVASAYAIHTARRGAEYGMTTGPVSVDFGRVMARKEKVRLDARSGVEKWLKGMKNCTVFEGHARFEGPREVRIGDELISGERIFVNVGGRAAVADLPGVNDVPYLTNSSIMDLAELPEHLVVVGGSYIGLEFAQMFRRFGSDVTVIEKGARLIGREDPEVSDAIREILENEGVRIRTNAECIRFSNHADSVAVGVDCTSGEPEVSGSHVLLATGRHPNTDDLGLDKAGVKTDERGYIEVDDSLRTNVPHIFAMGDCNGRGAFTHTSYNDFEIVAANLIDNDPRRVSDRIQTYALYIDPPLGRAGMTETEARKKGHKLLVGTRPMTRVGRAVEKGETQGFMKVIVDAETDEILGASILGTGGDEAVQSILDVMYAKKPYTMIARAVHIHPTVSELIPTVFGDLSSA

SEQ ID NO: 11678 - protein, 395 aa, Sinorhizobium meliloti 1021
MAGKSQFQWDDPFLLEDQLSEDERMIRDTARAYAQEKLQPRVTEAYREETTDPSIFREMGDLGLLGVTVPDTYGGVGASYVAYGLVAREVERVDSGYRSMMSVQSSLVIYPIFAYGSEEQKRKYLPKLISGEWIGCFGLTEPDAGSDPAGMKTRAIKTEGGYRLVGSKMWISNAPLADVFVVWAKSEAHDNAIRGFVLEKGAKGLSAPKIGGKLSLRASITGEIVLDNVEVGEEALLPNVEGLKGPFGCLNRARYGISWGALGAAEFCWHAARQYGLDRKQFNRPLAQTQLFQKKLADMQTEIALGLQGSLRVGRLMDEGRMAPEMISIVKRNNCGKALDIARMARDMHGGNGISEEYQVMRHMMNLETVNTYEGTHDVHALILGRAQTGLQAFF

SEQ ID NO: 11679 - protein, 491 aa, Sinorhizobium meliloti 1021
MALTPALTRHIRRPKIFASLDEVTRSSGQPAGPVFDVSNPSTGELLATLPDMGIDDARTAIDAAALAQPLWAGKPAKDRSIILRRWHDLIVEHADDLAAILTAEMGKPVGEAKGEVLHAASYVEWYAEEAKRVYGETFPAPANDRRMLVIKQPVGVVGTITPWNFPASMVARKISPALAAGCTIVLKPAEQTPLVAGAMFVLAEKAGFPEGVLNLLYASEGAPIGRELCGNPKVRKISFTGSTEVGRLLMRQCSDQIKKVSLELGGNAPFIVFDDADIDEAVDGAVQAKFRNAGQTCVSANRIYVQSAVHDAFAEKFVTRVRELTVGDGFAPDVAIGPMIDAHAIDKIEAHVADAVAKGAQVRSGGSRIGTTGTFFEPTVLTGISHDMRIAQEETFGPIAPIIRFETAEQVVAEANDTIYGLAAYFYAENLKRVWHVAEALEYGMVGINTGRMSSEAAPFGGIKQSGIGREGSRHGLEDYLEMKYLCMGNI

SEQ ID NO: 11680 - protein, 422 aa, Sinorhizobium meliloti 1021
MTSLTDRKNAAISRGVGMTTQVYADRAENAEIWDKEGNRYIDFAAGIAVVNTGHRHPKVIAAVKAQLDRFTHTCHQVVPYENYVHLAERLNAIVPGDFAKKTIFVTTGAEAVENAVKIARAATGRQAVVAFGGGFHGRTFMGMALTGKVVPYKVGFGAMPADVFHAPFPIELHGVTVEQSLSALKKLFAADVDPARVAAIIIEPVQGEGGFYPVPTAFMKALREVCDQHGILLIADEVQTGFARTGKLFAMEHHGVAPDLTTMAKSLAGGFPLAAVTGRAEIMDAPGPGGLGGTYGGNPLGIAAAHAVLDVIAEENLCERANQLGNRLKQRLAAIREKAPEIVDIRGPGFMNAVEFNDVRTNLPSAEFANKVRLLALEKGLILLTCGVHGNVIRFLAPITIQDEVFAEALDTIEASILEARG

SEQ ID NO: 11681 - protein, 477 aa, Sinorhizobium meliloti 1021
MTLHQNLIAGEWVGGDGVANINPSNTDDVVGEYARASAEDAKAAIAAAKAAFPAWSRSGILERHAILKKTADEILARKDELGRLLSREEGKTLAEGIGETVRAGQIFEFFAGETLRLAGEVVPSVRPGIGVEITREPAGVVGIITPWNFPIAIPAWKLAPALCYGNTIVFKPAELVPGCSWAIVDILHRAGLPKGVLNLVMGKGSVVGQAMLDSPDVQAITFTGSTATGKRVAVASVEHNRKYQLEMGGKNPFVVLDDADLSVAVEAAVNSAFFSTGQRCTASSRIIVTEGIHDRFVAAMGERIKGLVVDDALKPGTHIGPVVDQSQLNQDTDYIAIGKQEGAKLAFGGEVISRDTPGFYLQPALFTEATNEMRISREEIFGPVAAVIRVKDYDEALAVANDTPFGLSSGIATTSLKHATHFKRNAEAGMVMVNLPTAGVDFHVPFGGRKASSYGPREQGKYAAEFYTNVKTAYTLA

SEQ ID NO: 11682 - protein, 294 aa, Sinorhizobium meliloti 1021
MASIGFIGLGIMGTPMARHLQDAGHEIITSKFVIPPRQELVENGLEIVETPKALAETVDTIILMLPDTPEVKDVLFGENGVYYGLGEGKLVIDMSSISPIETKEFAKKVRETGAEYIDAPVSGGEVGAKNASLSIMAGGKPSSFERALPLFKLMGKNITLVGDCGDGQVTKVANQIIVALTIEAVSEALVFASKAGADPARVREALMGGFASSRILEVHGDRMIKRTFEPGFRISLHQKDLNLALQGAKSLGISLPNTAATQELFNNCAANGDSGLDHSGLVRALERMANHEVA

SEQ ID NO: 11683 - protein, 298 aa, Sinorhizobium meliloti 1021
MTKIAFIGLGNMGGPMAANLVKAGHAVTGFDLSEASRNAAAKTGVSVAGSIAQAVREMECVITMLPASAHVLYVWDELLGFVDPGTLLIDSSTIDVESARKVHGFAEKAGCPSLDAPVSGGTAGAAAATLTFMVGGSEGAFSRGKHLLEAMGKKIVHCGDAGAGQAAKICNNMILGVSMAAVCEAFVLAERLGLSHQALFDVASTSSGQCWSLTTYCPVPGPVPTSPANGGYKPGFAASLMLKDLKLSQQAASASGAATPMGAQATQLYSLFEKLGHGAEDFSALIHLLRGNEEAKEG

SEQ ID NO: 11684 - protein, 510 aa, Sinorhizobium meliloti 1021
MRAVLEQVEARRAEARAGGGERRIAAQHGKGKLTARERIDVLLDEGSFEEYDMYVTHRSVDFGMAGQKIPGDGVVTGWGTINGRQVYVFSQDFTVLGGSLSETHAQKICKIMDMAARNGAPVIGLNDSGGARIQEGVASLAGYAEVFRRNAEVSGVIPQISVIMGPCAGGAVYSPAMTDFIFMVRDSSYMFVTGPDVVKTVTNEIVTAEELGGARTHTTKSSVADGAYENDIEALEHVRLLFDFLPLNNREKPPVRPFHDDPGRLEMRLDSLIPDSAAKPYDMKELILAIADEADFFELQASFARNIITGFIRIEGQTVGVIANQPMVLAGCLDIDSSRKAARFVRFCDAFSIPILTLVDVPGFLPGTAQEYGGVIKHGAKLLFAYSQATVPMVTLITRKAYGGAYDVMASKHIGADVNYAWPTAEIAVMGAKGATEILYRSELGDPAKIAARTKEYEERFANPFVAAERGFIDEVIMPHSSRRRIARAFASLRNKQVETRWRKHDTIPL

SEQ ID NO: 11685 - protein, 355 aa, Blumeria graminis
MSTRAPNATTGSRKISFNVSEQYDIQDVVGEGAYGVVCSALHKPTGQKVAIKKITPFDHSMFCLRTLREMKLLRYFNHENIISILDIQKPRSFDSFTEVYLIQELMETDMHRVIRTQDLSDDHCQYFIYQTLRALKAMHSANVLHRDLKPSNLLINANCDLKVCDFGLARSAASQEDCSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKQMFPKTSDLALDLLEKLLAFNPVKRITVDEALQHPYLEPYHDPEDEPTADPIPEEFFDFDKNKDNLSKEQLKELIFQEIMR

SEQ ID NO: 11686 - protein, 503 aa, Hordeum vulgare subsp. vulgare
MVAPAKIPQRQLFIDGEWRAPALGRRLPVINPTTEVSIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEVGLPSGVLNIVTGLGNEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKTEGATILTGGVRPKHLEKGFFIEPTIITDINTSMEIWREEVFGPVLCVKEFSTEEEAIELANDTHYGLAGAVISGDRERCQRLAEEIEAGCIWVNCSQPCFCQAPWGGNKRSGFGRELGEGGIDNYLSIKQVTEYTSDAPWGWYKAPAN

SEQ ID NO: 11687 - protein, 506 aa, Hordeum vulgare subsp. vulgare
MAAPPAIPRRGLFIGGGWREPTLGRRIPVINPATEDTIGDIPAATAEDVELAVAAARSAFLLDGGSRWARASGATRAKYLNAIAAKIKEKISYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVIFDDVADIDKAVEWAMFGCFFNGGQVCSATSRLLLHEKIAERFLDRLVEWAKNIKISDPLEEGCRLGSVISKGQYEKIKKFISTARSEGATILHGGDRPKNLGKGFFIEPTIITGVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 11688 - protein, 469 aa, Pileostegia viburnoides
  misc_feature (18)..(18): Xaa can be any naturally occurring amino acid
  misc_feature (137)..(137): Xaa can be any naturally occurring amino acid
TKASVGFKAGVKDYKLTXYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPVXYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 11689 - protein, 469 aa, Hydrangea arborescens
  misc_feature (3)..(3): Xaa can be any naturally occurring amino acid
TKXSVGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRNLAREGNEIIREASKWSPELAAACEVWKEIKFEFEAMDTL

SEQ ID NO: 11690 - protein, 471 aa, Schizophragma hydrangeoides
NETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11691 - protein, 469 aa, Cardiandra alternifolia
  misc_feature (110)..(110): Xaa can be any naturally occurring amino acid
  misc_feature (304)..(304): Xaa can be any naturally occurring amino acid
  misc_feature (320)..(320): Xaa can be any naturally occurring amino acid
  misc_feature (432)..(432): Xaa can be any naturally occurring amino acid
TKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNXFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIXFRVLAKALRMSGGDHXHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLXREGNEIIREASKWSPELAAACEVWKEIKFEFEAMDTL

SEQ ID NO: 11692 - protein, 470 aa, Philadelphus hirsutus
ETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11693 - protein, 469 aa, Philadelphus caucasicus
TKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11694 - protein, 470 aa, Philadelphus purpurascens
ETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREIALGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11695 - protein, 469 aa, Deutzia rubens
TKASVGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11696 - protein, 473 aa, Kirengeshoma palmata
PTNETKASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11697 - protein, 467 aa, Fendlerella utahensis
ASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIRERSKWSPELAAACEVWKEIKFEFAAMDTL

SEQ ID NO: 11698 - protein, 471 aa, Whipplea modesta
NETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELAVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFQAMDTL

SEQ ID NO: 11699 - protein, 470 aa, Hydrangea anomala
  misc_feature (293)..(293): Xaa can be any naturally occurring amino acid
ETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLSHYCRDNGLLLHIHRAMXPVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11700 - protein, 469 aa, Hydrangea quercifolia
TKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 11701 - protein, 347 aa, Solanum tuberosum
MADECAAFVKGTELPVKRPREEEAETEMEAANNSNNNNGCSTNEKEEPSPYISSVLPGWFSEISPLWPGEAHSLKVEKILFQGKSDYQNVLVFQSSTYGKVLVLDGVIQLTERDECAYQEMITHLPLCSIPNPKKVLVIGGGDGGVLREVSRHSSVEQIDICEIDKMVVEVAKQFFPDVAVGYEDPRVNLRIGDGVAFLKNVPAGTYDAVIVDSSDPIGPAQELFEKPFFESIAKALRPGGVVATQAESIWLHMHIIEEIVANCRQIFKGSVNYAWTTVPTYPSGMIGFMLCSTEGPAVDFKNPINPIDDESPVKTIEPLKFYNSEIHQASFCLPSFAKRVIETKGK

SEQ ID NO: 11702 - protein, 126 aa, Schizosaccharomyces pombe
MSESVLLDEIFTVTSVDKQKYQRVSRITAVSGQNDMNLTLDINSQIYPLEKDATFSLQITSNLNSPDLKEAADYIMYGKVYRVEEAKDEKVSVYVSFGGLLMAIEGSHRKLYRLSLDHVYLYLEGK

SEQ ID NO: 11703 - protein, 298 aa, Agrobacterium tumefaciens str. C58
MATKMSTPSASSLEWMYKIMTVRMDKRFADLRAENRPALITYFMGGDPDFQTSLGIMKALPEAGADVIELGMPFSDPMADGPAIQLAGQRALKGGQTLKTTLDLAREFRKQDNATPIVMMGYYNPIYIYGVEKFLDDAIASGIDGLIVVDLPPEMDDELCIPALARGINFIRLATPTTDGKRLPAVLKNTSGFVYYVSMNGITGSALPDPSLISGAVGRIKAHTELPVCVGFGVKTADHAKAIGAVADGVVVGSAIVNQIAGSLTKDGQATADTVPAVTTLVKGLSTGVRASRLAAAE

SEQ ID NO: 11704 - protein, 287 aa, Agrobacterium tumefaciens str. C58
MNLITNRIAFQGEFGANSDMACRDMFPDMEPLPCPTFEDAFNAIENGEADLGMIPIENTLAGRVADIHHLLPESRLHIIGEYFMPIRFQLMVVPGVTKDEIRTVHSHIHALGQCRKIIRSNGWKPVIAGDTAGSARLVSEKGDRSMAALAPRLAADLYGLDILAENVEDSENNVTRFVVLSRDENWAKRQSSDEIVVTTFVFNVRNIPAALYKAMGGFATNGINMTKLESYQLGGKFVATQFYADIEGHPDDEPVRHALDELRFFSEKVRILGVYNGHAMRGKLNQS

SEQ ID NO: 11705 - protein, 452 aa, Agrobacterium tumefaciens str. C58
MYDIENAKKFFADNPDIEILEAFVIDANGVPRGKWIPRERAIDVLEKGMAIPRSVYALDIWGRDVHAAGLAEGTGDPDGFCFPVPGTLSRVTWLGRPTAQVLLAMKNADGTGFYGDPRHVLSQVLNAYKKAGLTPVVATELEFYLIDPVRSALDPVRPPHSREGRWHTGQTQVLSISELQDFEDVFHDIATACRAQGVLADTTLRENGPGQYEINLNHVPDALQAADFAVFLKRIVKGVARRHELDATFMAKPYGLQAGNGMHVHFSVLDRDGRNIYAGENGPSDALMHSVGGLLENMGESMAIFAPHANSYRRLTPSEHAPTYASWGIDNRSAAVRVIVASKAATRIEHRVAGADTNPYLVLAMILSAAIAGMKEKRQPGGAIAGDSHAINHEPLPTNWDYALQRFTRSSFAYATLGQKYRTLFSACKQQELSEFSLRVTDVEYDAYIRTV

SEQ ID NO: 11706 - protein, 369 aa, Agrobacterium tumefaciens str. C58
MIEQPKRICSDYFYRHETLFSDHALMTGGSLWKDEQMKKRTLGNNLSVSALGLGCMGMTHAYSPTGDENSAIATLHRAVELGVTFFDTAEVYGPYNNEILVGKGLKPYRDKVVIATKFGFRIDPSKPAGQMMVGTDSRPENVRAVAEASLKRLGVDVIDLFYQHRVDPNVPIEDTLGAMAELVQQGKVKYLGLSEASAETLRKAHAVHPIAAIQSEYSLWTRDVEENGVLETCRELGIGFVPFSPLGRGALTGALKSLDGLAADDFRRGLPRFQSENFDANLALIKLLEDMAAEKGVTAGQLALAWVLAQGDFIVPIPGTTKIANLEKNVAATDVSLTADEVASLGALLSPAKVAGERYPERMSQMANR

SEQ ID NO: 11707 - protein, 313 aa, Agrobacterium tumefaciens str. C58
MRRTVMILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 11708 - protein, 503 aa, Agrobacterium tumefaciens str. C58
MVMARIIQTPTGLDALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 11709 - protein, 348 aa, Agrobacterium tumefaciens str. C58
MTPTSEELPLPMSDTKTLPETMRFIDLPSHGGPEVMQSSKAPLPKPARGEILVKVEAAGVNRPDVAQRQGIYPPPKGASPILGLEIAGEVVALGEGVDEFKLGDKVCALANGGGYAEYCAVPAGQALPFPKGYDAVKAAALPETFFTVWANLFQMAGLTEGETVLIHGGTSGIGTTAIQLAKAFGAEVYATAGSAEKCEACVKLGTKRAINYREEDFAEIVKSETGGKGVDVVLDMIGAAYFEKNLAALAKDGCLSIIAFLGGATAEKVDLRPIMVKRLTVTGSTMRPRTADEKRAIRDELVEQVWPLIESGKVAPVINRVFTLEEVVDAHRLMESSNHIGKIVMKVS

SEQ ID NO: 11710 - protein, 484 aa, Agrobacterium tumefaciens str. C58
MPNRSCPAMFGGRGGVSAVAFMGVRSVMNEVSKPMSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHLRDTREHF

SEQ ID NO: 11711 - protein, 424 aa, Agrobacterium tumefaciens str. C58 [sequence omitted]

SEQ ID NO: 11712 - protein, 368 aa, Agrobacterium tumefaciens str. C58
MFDASITIRGGTTMFTTSAYACDDGSSPMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSLPRQKAA

SEQ ID NO: 11713 - protein, 432 aa, Agrobacterium tumefaciens str. C58
MSAAFKNKKRTFVMGRQNRSIPMRKVMEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 11714 - protein, 295 aa, Agrobacterium tumefaciens str. C58
MVFLPSSTQPSIFREGALETQDQKPQETKTAKNGREAVLSVEGVTVGFNGRNVLEDLNLDVYRGEILGFIGPSGAGKSVLMRAILRLLPRQAGAIRILGTDYDKASEDDRMMLDQRLGVLFQQGALFSGLTVKENIQLPMREYLDLPKKLMDELAYLKIEMVGLKPDAGDKYPSELSGGMIKRAALARALSLDPDLVFLDEPTSGLDPIGAAEFDMLIARLRDSLGLTVYMVTHDLDSLFSVCDRIAVLGDKRVLVEGTLQDMFACDDPWVQSYFRGKRARSVVLPDGKHENPVE

SEQ ID NO: 11715 - protein, 161 aa, Agrobacterium tumefaciens str. C58
MKPSAFLPGVAMSIPFPSAPADKEALENAGLFSPKFDAHGLVTAVVTDARDGELLMVAHMNAEALSLTLETGIAHYYSRSRDKIWKKGETSGNLQTVKEFRTDCDQDAVWLKVSVAGHDATCHTGRRSCFYRTVELSNGDAVTKITDDTRHFDPATTYSNT

SEQ ID NO: 11716 - protein, 459 aa, Agrobacterium tumefaciens str. C58
MERAGHAVAASGLRHYPQALRFVVLCGGGNNGGDGYVAARALVQSGATVTVHHLGDAGTLRGDARVAFERSGLVPLPLGDYTPLAGDVVIDAVFGAGLSRDVPQELARIIEAVTSARVPVLAVDLPSGLCGRRGVPLGASFRAERTVTFMARKPGHLLMPGRELCGALEVFDIGIPLRILADHAGSVAENHPLVWRDALPASDLETHKFRRGHLTVFSGPAHATGASRMTALAALKAGAGIVTIAAPKEALDLLSVTLTAVMNAPMDNADDLRLWLDDQRHGTFVLGPGFGDLKKARQFVSLLGDKAAVLDADAITAFKDHAAALFERITSGAGKFVLTPHEGEFARLFPDLAADRTLSKIEKAQVASARSGAALVYKGADTVIAAPDGRALVSTNAPASLATAGSGDVLAGIIGALLAQGTPAFEAAAAGVWLHGEAGHRAGDGMTAEDLAHAVRPFG

SEQ ID NO: 11717 - protein, 241 aa, Agrobacterium tumefaciens str. C58
MPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASLDA

SEQ ID NO: 11718 - protein, 477 aa, Agrobacterium tumefaciens str. C58
MASDIGDVWLDRSKAHIRVEPAGHSRRIMQGRGDADPYRMARSCVKGRNMSTNYLSAASVRTKNPAGVIATCGLMIMFDGYDLVVYGAVAPALLKESTWALNPAMVGRAAALTLVGMLLGALFAGTMADRIGRRKVVLLSLAGFSAMMIASAMTPNFLAFEITRFFAGLGLGALLPTVTALVLEFSPPQRRAQANSLSFLGYLIGGIISGILGMLLLESYGWRPLMLIGGLPLILLPIFMRFLPESPEWLASKGRQAEADGICDSYGLQRIVPHAKMQKGGVGALFSEGRLASTLNAWGIHFCSLLLTFGMVNWLPTIMNKMGYDISSALSFSVMLNVGAAIGILIGGRFADKGNVKVVVAILFAVGAASIFALTANKGPLLYVFVALAGAGTIGTQILANVLVGRLYPVHIRGTGLGFSLAVGRLGGIAGPMIGGLVLQRGLAPEWNFYIFGSVAVVGLMLTVLTLLYRTSGDARV

SEQ ID NO: 11719 - protein, 194 aa, Agrobacterium tumefaciens str. C58
MFPGRRGSKPCLRPFPALRQCGFPMTIKAEDLPYRPCAGIMVLNAQGLVWAGRRIKEGNSEYDGSPQLWQMPQGGIDDGERPLTAAIRELYEETGMKTVTLLAEASDWIHYDLPPELIGIGLRGKYRGQAQRWFAFRFEGDESEIQIDPPPTGHSAEFDAWDWKPMESLPELIVPFKRAVYEKVVAEFQHLSGK

SEQ ID NO: 11720 - protein, 476 aa, Agrobacterium tumefaciens str. C58
MDIWTRDFAMQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 11721 - protein, 484 aa, Agrobacterium tumefaciens str. C58
MKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 11722 - protein, 243 aa, Agrobacterium tumefaciens str. C58
MPEVIVENVHKSFGALEVLKGVSLTVGRGEVFALIGRSGSGKSTLLRCMNGLEKINSGRIEIAGHALGGDATALRKLRTDVGIVFQSYNLFPHLTVGENIMLAPRIVKDVAKSETKDIAREVLQLVGLSEKFDSYPDQLSGGQQQRVAIARSLAMRPKVMLFDEVTSALDPELTEEVLTVMENLAKGGMTMILVTHEMAFARRVATETIFMHKGKIWEQGRSAELFANPQTPELRQFVKADVK

SEQ ID NO: 11723 - protein, 466 aa, Agrobacterium tumefaciens str. C58
MDRKASRMTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 11724 - protein, 327 aa, Agrobacterium tumefaciens str. C58
MFILPCLHGLVQRSVGKARTGMDIRLVGAPLQIGAGQLGCEMGPSAYRVAGLAHALEELGHRVVDTGNVMPAPLREFCHPNPAVHHLAETVAWTEALTEAAYRESADAVPIFLGGDHAISAGTVAGMARRVAETGRPFFVLWLDAHTDYHTLETTRSGNLHGTPVAYFSGRDGFSGYFPPLSHAVAEENIGMIGIRSVDPAERAALEKSGITVHDMRSIDEHGVAVILREFLARVQAANGLLHVSLDVDFLEPSIAPAVGTTVPGGATFREAHLVMEMLHDSGLVCSLDLVELNPFLDERGRTATLMVDLATSLMGKRVMDRPTRAG

SEQ ID NO: 11725 - protein, 511 aa, Agrobacterium tumefaciens str. C58
MRREPIMHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 11726 - protein, 492 aa, Agrobacterium tumefaciens str. C58
MNGGSRPMTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 11727 - protein, 426 aa, Agrobacterium tumefaciens str. C58
MRPDRLASAIRHSMVRPELATNQDRPMPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 11728 - protein, 470 aa, Agrobacterium tumefaciens str. C58
MLLDEGSFEEYDMYVTHRAVDFGMAEQKVAGDGVVTGWGTINGRQVYVFSQDFTVLGGSLSETHAQKICKIMDMAVRNGAPVIGLNDSGGARIQEGVASLGGYADVFKRNVVASGVVPQISVIMGPCAGGAVYSPAMTDFIFMVRDTSYMFVTGPDVVKTVTNEIVTAEELGGASTHTKKSSVADGAYENDIETLEHVRLLFDFLPLNNREKPPVRPFHDDPARLEARLDTLIPDSSNKPYDMKELIHALADEGDFFELQEAFARNIITGFIRLEGQTVGVVANQPMVLAGCLDIDSSRKAARFVRFCDAFNIPLLTLVDVPGFLPGTAQEYGGVIKHGAKLLFAYSEATVPMVTLITRKAYGGAYDVMASKHIGADVNYAWPTAEIAVMGAKGAAEILYRSELADPEKIAARTKEYEERFANPFVAAERGFIDEVIMPHSSRRRIARAFASLRNKSVETRWKKHDTIPL

SEQ ID NO: 11729 - protein, 483 aa, Agrobacterium tumefaciens str. C58
MKVVPMHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 11730 - protein, 275 aa, Agrobacterium tumefaciens str. C58
MEHAMSAPAPQNAAQAPVTKALVELEGIHLSFGDNQVLKGIDLTVNKGDAVSIIGPSGSGKSTILRCINGLLIPQSGKITVGGTRVDQLKTEAERIALRKRIGIVFQQFNLFPHLTVMENITIAPIKILGTPKAEAERHARELLEKVRLSQKVDAYPGQLSGGQQQRVAIARALAMRPELVLFDEVTSALDPETVGEVLAVIRDLVNDGMTSILVTHEMRFAEEISDKIVFTENGLIVDQGTPEHIFYRSTNPRINAFVKGLGGQVARVTDGEGI

SEQ ID NO: 11731 - protein, 1344 aa, Agrobacterium tumefaciens str. C58
MPGAPMDRNVTAERQLEPTVFAPIAPSLPVREDEPYARDEMLHEIFEQTAKRFQAKCAVRLLGHDPENSRRTRLSYAQLAERATRFARQLRAMGVQRGDRVVICLPRGLDQYMAILGTLWAGACYVPVDWSYPQDRIDFIAEDSGATLIVTDAERAGGMRVTTLVVNETLGDLAAQDAVPITRAESGASPDDLAYIIYTSGTTGRPKGVMISHRSACHFLRSEGAILAIEESDRVFGGFSIAFDMSIETMWSAFSAGAELLVATEALHKAGPDVGITLAAESVTVWHVVPSLFTLVEAEIPTLRIVNLGGEACPPDLVERWARPGLRILNTYGPTETTVTATWTEVQPGRRVTIGRPLPGYTAWIVDEKLWPVAAGAEGELVIGGPGLSGGYVNRPDLTADKFVNTPFYGPDGLPARIYRSGDLVRLDAVGDIEFMGRIDTQVKIRGFRVELAEIEAVIAEDASVAQAVVHLFRDNDGSELLAAFLVARGNAAIDMEAARKRVNDRLPNYMRPVVYQVLDALPTLPASGKVDRKALQRPVVVAVTDRETVAPETPLEIQLHAIWSEAFAPQKVSVEDDLFEDLGGHSLKAARLASAIRKSSGLSGVSIQDLYAAPTIRRLAERLRDRVTADTAVLEPFHRVSEFQKRLCWALQTIALVPIYAVAGLQWFFPYLAYTYLVEDFGRVSALLLGGLSFVFIPPLGMVFAIIVKWLIIGRYKPGDYPLWGSYYLRWWLVRRLSDIIATPYLSGTPMIRFYYRLLGARIGRRAFIGTVSIDTADLVTIGDDAIVSDYAMLATSSVERGLLRIGSVRIGNSAFIGTMSVVGRNSAIGDAAALDDLSSLPMNQSIPSGESWSGSPAKCIATGRIAQRDGEAGFLRRLLVGFGLFIAAVILPLVAILPIAPGLIAMIEIDWNTDGYSYLLISPFLALTYIILMCVLTVAAKRLILGPVRPGRYSIHSWFYLRFWFVQQVTDLALALLHPIYATLYVIPWYRALGVRIGKRAEISTAAKIVPDLVDIGPESFIADAVVFGAARHEPGIIELAHTRIGRRSFIGNSAVLPTGATIADGVLIGVLSKPPADGGAEQPDGTWFGSPPISLPVRQAVGLFDEGARFNPRPRLVAMRLAIEAIRVILPLTLFLAFFSLLFSVVGDIQDYDDSHLLIAVIFPFLYIGFALACGLSVVALKWLVMGRYKPTTKPLWSTFVWRTELVTATYENLAVPNLLQPLRGTPWLAFFLRLLGCKIGRDCFIDTTDITEHDLVRIGDEVALNEFSGLQTHLFEDRVMKVSGVTVGDRAVIGSYAIVLYDAEIGEDAQLGDLSVVMKGETLPAGTSWEGSPAQLVRNA

SEQ ID NO: 11732 - protein, 268 aa, Pseudomonas aeruginosa
MSRLQTRFAQLKQENRAALVTFVTAGDPDYASSLEILKGLPGAGADVIELGMPFTDPMADGPAIQLANIRALEGGQTLARTLQMVREFRSGDSETPLVLMGYFNPIHHYGVERFIAEAKEVGVDGLIVVDLPPEHNEDLCHPAQAAGLDFIRLTTPTTGDQRLPTVLEGSSGFVYYVSVAGVTGANAATLEHVEEAVARLRRHTDLPIGIGFGIRSAEHAAAVARLADGVVVGSALIDRIAKARDNAQAVKDVLALCGELAEGVRNAR

SEQ ID NO: 11733 - protein, 341 aa, Agrobacterium tumefaciens str. C58
MIVRPSQLCGDQSCSQEMNGAGEINASRHRKENELKTCQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDEQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 11734 - protein, 466 aa, Bowiea volubilis
VGFKAGVKDYRLTYYTPDYETKDTDILAAFRVTPQPGVPAEEAGAAVAAESSTGTWTTVWTDGLTSLDRYKGRCYHIEAVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFIFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEEDRSRGIFFTQDWVSMPGVIPVASGGIHVWHMPALTEIFGDDSVLQFGGGTLGHPWGNAPGAVANRVALEACVQARNEGRDLAREGNEIIREAAKWSPELAAACEVWKEIKFEFEPVDRLI

SEQ ID NO: 11735 - protein, 275 aa, Schizosaccharomyces pombe
MSRRSLRTLYVTGFRDGMRARELAYEFEPFGPLIRCDIPIPRTRTSRPFAFVEYEDSRDAEDAYYEVHGRRLERGGGVLRVEWAKQPPPSGPGSKRGGRRERGGRVHGDSGRLRSRSPSPHEARSRSPYNDERSDRRSMSPRYRSRSRSPDGRSRSPDYDRRSPKRNHRSPSPVSFAPQKSPVENETETNVDNGDTKISESNEKSGTEVEQQSAPNSNGNEEVNNLEPVCQNESKQEPPKEENSNVSQEQPEQAQPEVSAASEQPESNPTTTESQ

SEQ ID NO: 11736 - protein, 512 aa, Lycopersicon esculentum
MAVAAFGQLNLDESPLWGSRSIECFEKLEQIGEGTYGQVYMARDKQTGEIVALKKIRMDNEKEGFPITAIREIKILKKLQHENVIKLLEIVTSQGPEEDEPEKLGIDSNKYKGNIYMVFEYMDHDLTGLADRPGLRFTIPQIKCYMKQLLTGLHYCHINQVLHRDIKGSNLLIDNEGNLKLADFGLARSFSGDHNANLTNRVITLWYRPPELLLGATKYGPAVDMWSVGCIFAELLFGKPILPGKNEPEQLNKIFELCGTPDEINWPGVSKIPWYSKFKPARPMKRRVREVFRHFDRHALDLLDKMLNLDPSQRICAKDALDGEYFWTDPLPCDPRSLPKYESSHEFQTKKKRQQQRQNEEMAKRHKLQHPQQHSRLPPIQQPGHSQHWGGSTHQMSNSQPAISAGAGHHQFGKPRGTGGSNRYPPGGNPGGGYYQDRGAQGGGYSSGAYPPQGRAPPFPGSGLAPSGPRGPSGGYGGPPNYSQSGQYGGSGAGRGSNQMSGNRNQQYGWQQ

SEQ ID NO: 11737 - protein, 125 aa, Medicago truncatula
ISHGVSQSMTNVIRPPPPKRKRPHSEISSSTVQSGAEPVIVSTYADSLELNRSSSPEGFVSGTGSSNYQYEGAVSEDGTGKGTWDIFAHTPAMVKDGKNAHGAIDHYHRYKEHVQIMKNMNTDAY

SEQ ID NO: 11738 - protein, 390 aa, Lactobacillus sakei
MQTNWWQNAVFYQVYPRSFQDSNGDGIGDIQGIIQRLDYLADLGVNAIWLSPVYQSPNVDNGYDISDYQAINPEYGSMVDMEQLIEAAKIRKIKIVMDLVVNHTSDQHPWFLEARKSKDNPYRDFYIWRDPATDGSVPNDLQSNFKGSAWAFDAVTGQYYLHFYAKEQPDLNWQNPKVREAVYQMMTWWLQKGIGGFRMDVIDLIGKEPDRKIKENGPQLHAYLQEMNARVLSQYDVVTVGETWGATPEIGQMYSNPNRHELSMIFQFEQINLDKQSGMTRWDLKPLIPAELHAVFSKWQLALDGVGWNSLFWSNHDLPRIVSRWGDDSQYREKSAQALAIYLHMLKGTPYIYQGEEIGMTNYPITSYHEIEDIESRRVYQQRQQQGYAI

SEQ ID NO: 11739 - protein, 369 aa, Arabidopsis thaliana
MMHEMAYKVCVEKVKSLGIEFTTPIEETLRDTIVSLMEDYKERSKEIMNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 11740 - protein, 444 aa, Arabidopsis thaliana
MNPREFISNLPDEILGKILSLLPTKLGVSTSVLSKRWRNLILLVDNFDLEDSSTSGFSAFLEQTVARLNTCPIKRLSLNGRHYRFSSADSWISTAFERGCLELHLQSQYLDTGILSSNTLVKLTLSDQIYLQGLVPHDGTVFFPALKTLSLGAVVADRDVYESLISGCPVLDELSIRDGCDDPPTWKKSVVNKSVKRLTVSFHHPMSAWAYEDNVWFKTQSLVFLDYSAFVSQGYTIVDRMDSLVEARLDLRLWVSTDSYDSDYEDKDFDVYRPYDVFGDVTSLVSGIRKVKTLHLSPDSLEAFFFCCNHMPVFNNLRNLSLESDEEKGWQALPLLLNNSLNLHTLSIKGLVHRVTSRCGDACACISERKTGMCCLSACRIKVLEITGYGGSFIELKQMRHFLGKLQCLETVRIGVERDGNNEHLRANLSSLHRASSECNIQFI

SEQ ID NO: 11741 - protein, 505 aa, Arabidopsis thaliana
MDFGRSRDIISGLPDSLLCHILSFLNTKEAASTSVLAKKWRYLFASVPNLDFDDSVHLRLGKRNPAVSGEDYLKMINERSDQLSTSFMDFVDQVLRLQDNSPLHKFSLKIRDCVDIVRIICWILKVLERGVSDLELDMHLKWKSSLPSKIFLSETLVRLKLSVERGPFIDVEDVHLPKLKTLHIVSVKFEKHGIGLNKLLSGCHILEELNLEYISWCLWDFVSVSLTTLKRLTFCGEVMQDENPISVSFNTPNLVYLMFTDAIADEYSTVNFDSLVEAHINLQMSEDQVEQTRFSDSEGNMEGCMVANATELIMGICNVKILYLSVYTLEVLTYCCEAIPLFNNLTHLTIESNSEVGWESVSGLLKNSPNLETLVFKGLVHRFTDKCGDMCLCKPWEEDEEEEEDEETPTCLSSCPVKVLKILEFGKIYDDEIEKRIDQVKHFLEKIPDIEQLILHYNTPVDEDVIKVYQQLRRHPKVASSKCKLQLISDNLSLSSKDCALFGID

SEQ ID NO: 11742 - protein, 503 aa, Arabidopsis thaliana; identical to SEQ ID NO: 627

SEQ ID NO: 11743 - protein, 482 aa, Arabidopsis thaliana
MVEVYELLTVMVSLIVVKLFHWIYQSKNPKPNEKLPPGSMGFPIIGETFEFMKPHDAFQFPTFIKERIIRYGPIFRTSLFGAKVIISTDIELNMEIAKTNHAPGLTKSIAQLFGENNLFFQSKESHKHVRNLTFQLLGSQGLKLSVMQDIDLLTRTHMEEGARRGCLDVKEISSKILIECLAKKVTGDMEPEAAKELALCWRCFPSGWFRFPLNLPGTGVYKMMKARKRMLHLLKETILKKRASGEELGEFFKIIFEGAETMSVDNAIEYIYTLFLLANETTPRILAATIKLISDNPKVMKELHREHEGIVRGKTEKETSITWEEYKSMTFTQMVINESLRITSTAPTVFRIFDHEFQVGSYKIPAGWIFMGYPNNHFNPKTYDDPLVFNPWRWEGKDLGAIVSRTYIPFGAGSRQCVGAEFAKLQMAIFIHHLSRDRWSMKIGTTILRNFVLMFPNGCEVQFLKDTEVDNSSGSNPDCCNG

SEQ ID NO: 11744 - protein, 132 aa, Arabidopsis thaliana
MAKKWQQRAALRRKRISFHRSTDTTSSSTAAEKGCFVVYTSDRIRFAFPISYLSNSVIQELLKISEEEFGIPTEGPITLPFDSVFLEYLIRLVQRRMDGDTEKALITSISSTRCSLPCSFQLQEHSSTRLVF

SEQ ID NO: 11745 - protein, 141 aa, Arabidopsis thaliana
MMINAKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 11746 - protein, 132 aa, Arabidopsis thaliana
MAKKWQQRAALHRKRISFQRSSVFTSSSSTVEKGCFVVYTADKIRFAFPISYLSNSVVQELLKISEEDFGLPTEGPITLPFDSAFLEYLVKLIQRRMDEDTEKALLLSISSARCSFQPQEQQCSTTQQLLVF

SEQ ID NO: 11747 - protein, 458 aa, Arabidopsis thaliana
MDGAGEKRVRAKGSREVDWISNLPETLLCQVLFYLPTKDVVKSSVLSSRWRNLWKYVPGFNLSYCDFHVRNTFSYDHNTFLRFVDSFMGFNSQSCLQSFRLEYDSSGYGEPKLALIRRWINSVVSRKVKYLGVLDDSCDNYEFEMPPTLYTCETLVYLTLDGLSLASPKFVSLPSLKELHLSIVKFADHMALETLISQCPVLENLNINRSFCDDFEFTCVRSQSLLSFTHVADTDEMLNEDLVVAIDAPKLKYLRLSDHRIASFILNDLASLVEADIDTVFNLICKKMFNPNDLNKRNMIRDFLVGISSIKTLIIASSTLEVIYDYSRCEPLPLFRNLSSLRVDFYGYKWEMLPIFLESCPNLKSLVVGSANYREKEGINILSVPRGFLSSLEYVKIERPLKGEAMEMKLVSYLLENSTILKKLTLCLDDSIKKEESVILKELNTIPRLSSACQVVIL

SEQ ID NO: 11748 - protein, 452 aa, Arabidopsis thaliana
MDTGGDEKRARRSEEDRLSNLPESLICQIMLNIPTKDVVKSSVLSKRWRNLWRYVPGLNVEYNQFLDYNAFVSFVDRFLALDRESCFQSFRLRYDCDEEERTISNVKRWINIVVDQKLKVLDVLDYTWGNEEVQIPPSVYTCESLVSLKLCNVILPNPKVISLPLVKVIELDIVKFSNALVLEKIISSCSALESLIISRSSVDDINVLRVSSRSLLSFKHIGNCSDGWDELEVAIDAPKLEYLNISDHSTAKFKMKNSGSLVEAKINIIFNMEELPHPNDRPKRKMIQDFLAEISSVKKLFISSHTLEVIHDLGCELPLFRNLSSLHIDFEDHTLKMLSTFLQSCPNVKSLVVEFKDSSKEDGDRVLSIPRCFFTTLEYVKIERPITGEARGMKVVSYILENSPILKKLNLCLNSSREKSESVILKELLTIPRLSTSCKVVVFEPRSCWVLG

SEQ ID NO: 11749 - protein, 465 aa, Arabidopsis thaliana
MHAQRVARDLISGSPDEILGKILSFLPTHHAATTSVLSKRWRNLLPLVDKLELTEDHPSGRCSLGFPDFVEKTLALLDRPCSVIKKVHLNCDHLHGESRFYSWIRTVLERGVLDFHLESSRMYRVETEFFTSNTLVELTISGALYPEGELPPGGLFFPALKRLSIVLVAFADCDMYDDFVLGCPVLEELILYYADDDQPPGWNGKVSSPSIKRLTISHDYPDYPETHIYVWFDTPSLVYLDYSGHVARRYTAEMGSLEEARLNLLPWEQLIDSDEEDDDFDGYGPRWEKRSKDATGLIAMISNVKTLHLSSDSLEVIHSLCKVMPAFQNLLKLSFESDKERGWQVVPLLLNSSPNLETLVIKGLVHKVTSRCGDACLCIRKKTRGECCLLTCQVKVLKIIGYRGTCREQKQMSHFLANLKCLETVKVRVEVDHREDNDASNTYLRITNALMKLPRVSSNCRIHFL

SEQ ID NO: 11750 - protein, 502 aa, Arabidopsis thaliana
MSGFEDGFSAEKLFSQGYSYTYDDVIFLPHFIDFSTDAVSLSTRLSKRVPLSIPCVASPMDTVSESHMAAAMAALGGIGIVHYNCDIDTQASVIRHAKSLQVPIASDAVFKCPEHQIGSVDDFGPSSFVFVSQTGTLTPKLLGYVSKSEWSSMKDDQKEVKIYDYMKSCENKDYYVPWDIDLDKIEAVLEDKQKGFVVLEKEGETVNVVTKDDVERVKGYPKLGSGTVGADKKWMVGAAIGTRESDKERLEHLVKAGANVVVLDSSQGNSIYQLEMIKYVKNTYPELDVVGGNVVTMYQAENLIKAGVDGLRVGMGSGSICTTQEVCAVGRGQATAVYKVSTLAAQHGVPVIADGGISNSGHIVKALVLGASTVMMGSFLAGSTEAPGAYEYRNGRRVKKYRGMGSLEAMTKGSDQRYLGDTAKLKIAQGVVGAVADKGSVLKFIPYTMHAVKQGFQDLGASSLQSAHELLRDNTLRLEARTGAAQIEGGIHGLVSYEKKSF

SEQ ID NO: 11751 - protein, 449 aa, Arabidopsis thaliana
MDDETSVKEKQRNSDRISNLPDSLLCQILSDLSTKESVCTSVLSKRWRNLWLHVPVLDLDSNNFPDDDVFVSFVNRFLGSENEQHLERFKLIYEVNEHDASRFKSWINAVIKRRVCHFNVHNEVDDDDELVKMPLSLYSCERLVNLQLYRVALDHPESVSLPCVKIMHLDMVKYDADSTLEILISGCPVLEELTIVRDPNDSLEVVCVRSQSLKSFKIDSERYESQNHVVTIDAPRLEYMNLCDHRSDSFIIHNIGPFAKVDIDVIFNVEYNDPLEPDDSSKIAMLGKFLTGLSTVSEMVISSDTLQVIHDYCKMEQLPQFSNLSRLHAYFEDTWWEMLPTFLESFPNLHSLVMEFDCFPDTEQIDLSYVPQCFLSSLEFVHLKTPYVVNMQKEGRPLTGTSSKRKLAKYFLENGAALKKLTVSASFCNIIDEIKAIPRSSTSCQVVMD

SEQ ID NO: 11752 - protein, 464 aa, Arabidopsis thaliana
MAEPSVKKSKLTESDWISGLADDLLLQILSKVPTRESVFTSRMSKRWRNLWRHVPALDLDSSKFPHESDLEDFFDSFLQFDGNLKIERFKWIYNVEEHCDPEFVSRIDHVVKRGLKDLTILSKVNIEDDSVRMPVSLYSCATLVNLTLYSVVFDAPRAQLVSLPCLKTMHLEAVKFDGETILGTLISSCSFLDELTIITHDHDELGDVSVRSPSLRRFKLESMREDYDECEDPNVEVDTPGLEYMSITDYQSESFIIHNISPCAKVNIDVVFDAEDEDSVIHDFITAISTVRELTISARTLEMIHDYVESETELVPQFSNLFCLHASFSESSWEMFPTFLGCCPNLHSLFLEFDCLPEKEEINLSLVPHCFESSLEYVQLKVPITVSETSSKMELAIYFVRNCSVLKKLMLNESFGNVINKVRKIPKRSEGCKIAMPKPLHENVSHGSSLLPLICGFIPKILDQ

SEQ ID NO: 11753 - protein, 419 aa, Arabidopsis thaliana
MDYLPVEVIGNILSRLGGARDVVIASATCRKWREACRKHLQTLSFNSADWPFYRDLTTNRLEILITQTIFQTMGLQGLSIMMDDANKFSAATVIAWLMYTRDTLRRLSYNVRTTPNVNILEICGRQKLEALVLAHNSITGVEPSFQRFPCLKSLSLSYVSISALDLNLLLSACPMIESLELVSLEIAMSDAQVTIELSSPTLKSVYFDGISLDKFILEADSIEFLHMKDCVLELFELIGNGTLKHFKLDDVSVIHLDIMETSESLEVVDVNHFTMVWPKFYQMISRSQKLKKLRLWDVVFDDDDEIIDVESIAAGFSHLTHLSLSYDLKDGAAHYSLQGTTQLENVTVLELGWTVINDVFSIWVEELLRRCPNLKKLIIYGVVSETKTQGDCQILATFTWSIVQLMRKYIHVEVQFEYE

SEQ ID NO: 11754 - protein, 340 aa, Arabidopsis thaliana
MDQTLTHTGSKKACVIGGTGNLASILIKHLLQSGYKVNTTVRDPENEKKIAHLRKLQELGDLKIFKADLTDEDSFESSFSGCEYIFHVATPINFKSEDPEKDMIKPAIQGVINVLKSCLKSKSVKRVIYTSSAAAVSINNLSGTGIVMNEENWTDVEFLTEEKPFNWGYPISKVLAEKTAWEFAKENKINLVTVIPALIAGNSLLSDPPSSLSLSMSFITGKEMHVTGLKEMQKLSGSISFVHVDDLARAHLFLAEKETASGRYICCAYNTSVPEIADFLIQRYPKYNVLSEFEEGLSIPKLTLSSQKLINEGFRFEYGINEMYDQMIEYFESKGLIKAK

SEQ ID NO: 11755 - protein, 457 aa, Arabidopsis thaliana
MYALIHHGRRLVQLQKLSNFRVSVQNGSALSNSFSFASVADATLIDSLKGNNFTVSYLVDSLGLTTKLAESISKKVSFEERRNPDSVLSLLTSYGFTKSQISSIITIYPRLLALDAEKSIAPKLQSLQSRGASSSELTQIVSTVPKILGKRGHKSITVYYDFVKDIIEADKSSSYEKLCHSFPQGNKKNKIRNISVLRELGVAQRLLFPLLISDGQPVCGKERFEESLKKVVEMGFDPETTKFVEALRVIYRMSDKTIEEKVNVYKRLGFGVADVWAIFKKWPSFLSYSEKKITHTFETLKSCGLLKHEVLLLLKKHPKCICSSEQKIVNSIETFLGLGFSRDEFAMMVKRYPQCIDYTAETVKKKTEFIVKNMNWPLEALVSIPQVFGYSLEKRTVPRCNVIKTLISKGLMKDGSEAPPMSSVLTSTDQAFLRRYVMKHDKLAPELMAIFTGENGK

SEQ ID NO: 11756 - protein, 418 aa, Arabidopsis thaliana
MYSLIRHGRSLVELQKWRHLRVLVQKASPLSNSFSSASAARLSPRVGRKGKSFTVSYLVDSLGLPKKLAESVSRKVSFEDKDNPDSVLNLLRSHGFTDSQISTIVTDYPQLLVADAEKSLAPKLQFLQSRGASSSELTEIVSTVPKILGKRGHKTISVFYDFIKETLLDKSSKSEKSCQPFPQGNLENKIRNLSVLRELGMPHKLLFPLLISCDVPVFGKEKFEESLKKVVEMGFDPSTSKFVEALCVVQRLSDKNIEDKVNAYKRLGFDVEYVWTVFKRWPNFLTHSEKKILNTIETFLGLGFSRDEFSVLIKRFPQGIGLSAEMVKKKTEFLVKKMNWPLKALVSNPAVLGYSLEKRTVPRGNVVQALISKGLIGSELPSISRVFVCTDQVFLNRYVKRHEDKQLETELMAIYRAS

SEQ ID NO: 11757 - protein, 413 aa, Arabidopsis thaliana
MVVYPNEEAENGSLRFVDFVNKTFALLGNSPIKKFSLRHEPRLYCVDAYLRWIFTAMEQERGLLELHLYADRYYYPVGIERELFTSNTLVKLTLSGRYDFQVETVFLPALKSLSLSSSFEIGFDKYCNLLDGFPALEELYIREAVSELSNALLSSGTFVKCASIKRLVVFTDCPKFKEDEDHQEPCFIAPSLVYLDYSSYLSENYDLIDLNSLVEARLNLRLLESFNNYGSSDNDGDVYGWDFNVPFDYYGDVTNLVAGITNITTLHLSPDSLEVFHFRCKSIPVFNNLLLNLSIESNKRNGWQVMPLLIRSCPNLHTLVIKGFVHRVTSKCGDACACIPKKQRKIGKKEEISEYGGSFQELEQMRHFLGKLERLETVKVGVHAENNNNNEFLRANLLTLPRLSSKCNNIQFI

SEQ ID NO: 11758 - protein, 470 aa, Arabidopsis thaliana
MTPPPNSISSRNVAVIGAGAAGLVAARELRREGHTVTIFERQKQVGGLWVCTPNVEPDLLSIDPDRTVVHSSVYQSLRTNLPRECMGYSDFPFVTRPDDESRDPRRYPDHREVMRYLQDFAKEFKIEEMIRFETEVFRVEPTAENSCKWRVQFRSSSGVSGEDIFDAVVICNGHFTEPRLAHIPGIESWPGKQIHSHNYRVSDPFKGQVVIVIGYQSSGSDISRDIAILAKEVHIAAKSDAYAKESSIYSNLHFHPTIDRVYEDGSVVFQDGKLIFADAIVHCTGYKYCFPFLETKGYVNVEDNRVGPLYKHVFPPALAPGLSFIGLPSMALQFFMFEIQSRWVASVLSGRVKLPSEEQMMEDVIAFYAKLKSLGIPKRFTHFLTDPQWTPMFEKLKPHEAVLISQSEYFNWIAEQCGCSSIERWREEQYNIAIKKDDDNFRDEWDDDDQIIQEAYRDFAKFKPSKVWST

SEQ ID NO: 11759 - protein, 468 aa, Arabidopsis thaliana
MTSVITSRARHVAVIGLGAAGLVAVRELRREGHTVIGFEREKHVGGLWVYTDRVDSDSVSVDPDRTIVHSSIYQSLRTNLPRECMGYSDFPFVTRSSDGDPRRYPDHREVLMYLQDFAKEFKIEDMIRFETEVLCVEPSPENNRKWRVQFKSSNGVSGEEIFDAVVVCNGHFTEPRLAHIPGIESWPGKQIHSHNYRIPDPFKDEVVIVIGSQASGNDISTDIATIAKEVHISSKMVASDSYGCYDNLRIHPTIYRAREDGSVVFRNGKVVFADAIVHCTGYKYHFPFLKTSGYVTVEDNRVGPLYKHVFPPALAPGISFIGLPFMGLQFFMFEIQSKWVASVLSGRVKLPAEDKMMEEAVAFYSKLEDLGIPKRYTHFLTDPRGNPMLGTFKPEDAVVISQSDYFNWIAKQCGCTSIERWRERLYNVAIKKVFFGGDSYRDRWDDDQLIEEVYREFAKLKPNQDCSS

SEQ ID NO: 11760 - protein, 510 aa, Arabidopsis thaliana
MASWTSSEFLYEEVKPPGIHFLERFRRSGKLSFKQYQAMVFVLTFIAYIAFHATRKPNSIVKGTLSEQPTGHFKGADKGGWAPFDGPDGTALLGQIDLAFLSVYAVGMFVAGHLGDRLDLRTFLTIGMVGTGVCTALFGVAFWANIHAFYYFLAIQTLAGWFQSIGWPCVVAVLGNWFDKKRRGVIMGVWSAHTSLGNIIGTLIATGLLKFGWGWSFVGPALLITFLGIVVYLFLPVNPHAVEAERDGSEVDSTMRLGDTITESFLSSRTSTGFDRRAVGFLAAWKIPGVAPFAFCLFFTKLVSYTFLYWLPFYVSQTEIGGEQLSQETSGNLSTLFDVGGVVGGILAGYFSDQLDGRAITAGGFIYLTIPALFLYRIYGHVSMTINIILMFVAGLFVNGPYALITTAVAADLGTHKSLKGNARALATVTAIIDGTGSVGAAIGPVLTGYIAAISWDAVFYMLMTAALISGLLLTTLIIEEVKTLLYGSSEEDHEVAAASTSRPPIDVLI

SEQ ID NO: 11761 - protein, 134 aa, Arabidopsis thaliana
MEFVKGDQVEVCSKEDGFLGSYFGATVVSKTPEGSYYKIKYKNLVSDTDQSKRLVEVISADELRPMPPKSLHVLIRCGDKVDAFDKDGWWVGEVTAVRRNIYSVYFSTTDEELEYPLYSLRKHHEWVNGSWVRQ

SEQ ID NO: 11762 - protein, 334 aa, Arabidopsis thaliana
MSESKTQMTNFVFPLQNLVLRDFLGSKIDPRSGRDLTGYVMCSLILHGRRSIELHKWRNFSVSVKLLQNVFSAFSNSFSTVASAAADVSLIDSQKGKNFTVSYLVDSLGLPKKLAESISKKFRFEDKANPDSVLSLLRSHGFTVSQISIPKLLGKRGHKTLSLYYDFVKESLEADKSSKYETLCQSFPQGNLENKKRNVSVLRELGMPHKLLFPLLISVGQPVCGKDRFNTSLKKVVEMGFDPTTAKFVKALHVSYEMNDKTIEEKVNVYKMLGFAVEDVWVIFKKWPYSLKYSEEKITQTIETLKMCGLRGPSSFEEVSSIHTYLRAEDIELN

SEQ ID NO: 11763 - protein, 497 aa, Arabidopsis thaliana
MVPAVNPPTTSNHVAVIGAGAAGLVAARELRREGHSVVVFERGNHIGGVWAYTPNVEPDPLSIDPTRPVIHSSLYSSLRTIIPQECMGFTDFPFSTRLENGSRDPRRHPGHSEVLAYLRDFVREFKIEEMIRFETEVVRVEQAGENPKKWRVKSRNFGDISDEIYDAVVVCNGHYTEPRHALIPGNKINHSFSIGLGIDTWPGKQIHSHNYRVPEQVKDQVVVVIGSSVSGVDISRDIANVTKEVHISSRSTKPETYEKLPGYDNLWLHSNIETVREDGSVVFKNGKTVYADTIMHCTGYKYYFPFLDTKGEVTVEDNRVGPLYKHVFPPALSPGLSFIGLPWQNMKLQTLDVNELIGQCFGYLLVIPFPMFELQSKWVAAVLAGRVSLPSQEEMEDTKMFYLKLEASCIPKRYTHLMAELDSQFVYNNWLADQCDYPRIEKWREQMFYKVFKRIQSQASTYKDDWDDDHLIAEAYEDFVKFPSNYPSSLIEREYTS

SEQ ID NO: 11764 - protein, 173 aa, Arabidopsis thaliana
MDPAGASVASAIGGEGEKFAVGNIYSVKVITGDEFRGIGTKPRPGHLKNTRMVNASFITGLSYLGKTEDPLDSDNFSVDLNGLRAKEALAIRQAEADAERMGVGVTAEAQSIFDALSKTLPVQWENSDILVMKEVRVRSPYLSDCVFGGTDAANNRVKKVLELERRRLQLFGT

SEQ ID NO: 11765 - protein, 305 aa, Arabidopsis thaliana
MAILSASSTIVRAALDTQPKLRYNPNAPRNVKKNSNLSSFVPPSSPSSSSPATNLSVSVSDLLKRPASKDIGDGFDDTCVGYEKWFPSPPKVEKPRSVFNAASLAYIGDSIYEDPRIPSDDYVSVYSIKIVTMSLFFRMQECQMMIIFSDCSIKAATMSLCYVILTNKFLYLSLAVLGCKNIYARRHFLFPPLSIEEYNDRVRAVVRCEAQYALLQKLVDDDFLTKDERDILRWGKNVGSVKTRSTRRAGVAVYNKASSLETLIGYLYLSNGKRLEEMMQKLGFSSGSSTERMVKEAGSNKPSFK

SEQ ID NO: 11766 - protein, 450 aa, Arabidopsis thaliana
MAPALSPTRSHHVAVIGAGPAGLVAARELRREGHSVVVFEKQKQVGGTWIYTDEVESDPLSVDPTRSVVHSSVYRSLRINGTRECTGYRDFPFVVRSGVSRDRRRFPSHGEVLAYLKDFAKEFGIEEMVRFETEVVKVSPAAEEGIGKWRIESTEKEKKVRRDEIYDAVVVCNGHYVEPRLAQIPGISSWPGKEMHSHNYRIPEPFRDKVAVLIGNSSSAEDISRDIARVAKEVHVACRSNPADTFIKQTGYNNLWTHSMIESVHEDGSVVYQNGKTISVDIIMHCTGYKYHFPFLDTNGIVTVDDNRVGPLYKDVFPPAFAPWLSFIGIPWQVLPFPMFELQSKWIAGVLSGRIPLPSKEDMMIEIKTFYSTLEVQGIPKRYTHRMGNTQFEYDNWLASQCGCSETEEWRKEMCLANGVRKEAHPETYRDEWDDHHLVSEAYQDFSLYS

SEQ ID NO: 11767 - protein, 320 aa, Arabidopsis thaliana
MAEYLVTGGTSFIASHVIKSLLEFGHYVRTTVRDSEDEEKVGFLWDLKGAKERLKIFEADLTIEGSFDEAVNGVDGVFHIASRVSVRLDNNNLDKFDPNISGTMNVMNSCAKSRNTVKRIVLTSSSTAIRYRFDATQVSPLNESHWTDLEYCKHFKIWYAYKKTLGEKEAWRIAADKKLNLVVVIPSFCIGPILSPKPTSSPLIFLSIIKGTRGTYPNFRGGFVHIDDVVAAQILAMEEPKASGRILCSSSVAHWSEIIEMLRIKYPLYPFETKCGSEEGKDMPHSLDTTKIHELGFASFKSLTEMFDDCIKCFQDKGLL

SEQ ID NO: 11768 - protein, 123 aa, Arabidopsis thaliana
MKKLNSKGIRLSELMEKWRRRKKGHFAVYTNEGKRFVLPLDYLNHPMLQVLLQMAEDEFGTTIDGPLKVPCDGSLMDHIIMLVRRSMSHDYDDVEKSSTSSTCKGASISSLFRGQSQLQSLVS

SEQ ID NO: 11769 - protein, 381 aa, Arabidopsis thaliana
MRCFSCLNTQTNDMRINIDTLSDLTDYASVATKIDPRGTGSKSGILVNGKVNSPKPGGGARSFTFKELAAATKNFREGNIIGKGGFGSVYKGRLDSGQVVAIKQLNPDGHQGNQEFIVEVCMLSVFHHPNLVTLIGYCTSGAQRLLVYEYMPMGSLEDHLFDLEPDQTPLSWYTRMKIAVGAARGIEYLHCKISPSVIYRDLKSANILLDKEFSVKLSDFGLAKVGPVGNRTHVSTRVMGTYGYCAPEYAMSGRLTIKSDIYSFGVVLLELISGRKAIDLSKPNGEQYLVAWARPYLKDPKKFGLLVDPLLRGKFSKRCLNYAISITEMCLNDEANHRPKIGDVVVAFEYIASQSKSYEDRRTARKSTDSNRLRRETKQSY

SEQ ID NO: 11770 - protein, 374 aa, Arabidopsis thaliana
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNAMEAGFDGVEIHGAHGYLIDQFMKDKVNDRTDEYGGSLQNRCKFALEVVDAVAKEIGPDRVGIRLSPFADYMESGDTNPEALGLYMVESLNKYGILYCHMIEPRMKTVGEIAACSHTLMPMREAFKGTFISAGGFTREDGNEAVAKGRTDLVAYGRWFLANPDLPKRFQLDAPLNKYNRSTFYTSDPVVGYTDYPSLESTA

SEQ ID NO: 11771 - protein, 281 aa, Arabidopsis thaliana
MKKRTMSAWGSAILIFIILMIVTPTIPQSQAYHNFADQRSFLGIPNFLNVISNFPFLIIGLIGLILCFYPEDYFSFSLRGEKIGWTCFYIGVAAVAFGSSYYHLHPNDATLLWDRLPMTIAFTSIMAIFVIERIDEHKGTYSIAPLLLAGLVSILYWRFFDDLRPYALVQFVPCIVIPLMAILLPPMYTHSTYWLWAAGFYLLAKVEEAADKPIYSWTHHIISGHSLKHLCAAMVPVFLTLMLAKRTVQTERISLYKTWKKGSEEERFEHSYSNVAVEETR

SEQ ID NO: 11772 - protein, 448 aa, Arabidopsis thaliana
MSSVSTASLNCLPDELLVHVLSSLETKQAASTSVLSKRWRTLFAVRRNLDFDDSIISHPEVGEQNMDDVQESFRDFVDKRLAFQGSVPINKFSLIYGDKHDDVRVDRWINTALEHGVSELHLCLTSVTRRLHRFPSNVFRSTTLVKLTLGTNLFIVYFPSDTCLPVLKILVLDSIWFDRIKFSNVLLAGCPALEDLTIDQKSFPGLPNVVSSKTVKSLSIVYKYSADFDWFRTVALDTPNLVTLLYSTYARHRYRHCNLESLVNATLDLHFLENCDEAFEPNVTDLMIAVRNVQMLHLTSSATEVISQCCKGGLPMFKNLLVLVFLGNTERVWKVFLPLLLEHSPNLTKLCLESLFLILQGLYHGTDEDEFDEIHIPRSNKVNMLRIIQCQGTENELKHISHFLLKMECLQLVQVNFSETIVDSKKVQLTEDLMKLPSASSRLTMQVI

SEQ ID NO: 11773 - protein, 408 aa, Arabidopsis thaliana
MDRFFRTSLFGGKVIISMDNELNMEMAKTNRTPGITKSIARLFGEDNNLFLQSTESHKHVRNLTVQMLGSQSLKLRIMENIDLLTRTHMEEGARDGSLDVKETTSKILIECLAKKVMGEMEPEAAKKLALCWRYFPSGWFRLPFNLPGIGVYNMMKARKRMKTLLKEEVLKKREAGEEFGEFSKIIFGEKEGEKETMSMKNVIEYIYTFFVIANETTPRILAATVKFISENPKVMQELQREHAMIFENKSEEAGLTWEDYKSMTFTNMVINESLRISTTVPVILRKPDHDTKVGDYTIPAGWNFMGYPSAHFDPTKYEDPLEFNPWRWKGNDLDAIVSTNYIPFGAGPRLCVGAYFAKLLMAIFIHHLCRYRWSMKAEVTVTRSYMLMFPRGCDVQISKDTQEHDSDG

SEQ ID NO: 11774 - protein, 142 aa, Arabidopsis thaliana
MPDWGPVFVAVTLFVLLTPGLLIQVPGRGRVVEFGTFQTSGLSVIVHTLIYFTLVCILLLALQIHICNLFSTSMADWAPVLVGVVLFVILSPGLLFSLPGNNRTVDFGGLKTNGKAIAVHTLIFFAIYTILILALNLHIYTG

SEQ ID NO: 11775 - protein, 452 aa, Arabidopsis thaliana
MKKTLSPEPVTIYGNRQETFVGDMEYYTYFDESCIQDMNYFVKTITGIKSKGIRPDLIGSIIAHYASKWLPDLSGNVSAIISSTSLESKNNHNDTQPESVTASVMKKRFFVETLIGILPPEKDSVPCNFLLRLLRTAKMVGANPNYLTELETRVSWQLDQASLKELMIPSFSYTSGTLLDIELVTRLVNKFSGLDSEGVKTAAALVKVAKLVDSYLAEAAVDGGLALPEFISLITALPSHARTTEDGLYRAIDTYLKAHPQVLKQERKELCRLIDSRKLSPEAALHAAQNDRLPVRAIIGVLFTEQTKLSRHIDCNSSSISSTTRSPTNASGSHYLEGGSAARCLSKREMNVQQAEIRRLREDVVRLQSQCGAMHFQLERLMEKKSSGGSKGFFRWKRLGLVPSIRGSVSVEKGEEESGDNGEGFEPRTPGNMKTRLVKGRTTPSRWRKSMS

SEQ ID NO: 11776 - protein, 457 aa, Arabidopsis thaliana
MAVKKKSSWRSLMVLCFQDPDNIYSPKKTKKDDGERVITKQKSFLGLSILDISNPSSTTLSEDLSISLAGSDLHVFTQAELRVITQSFSSSNFLGEGGFGPVHKGFIDDKLRPGLKAQPVAVKLLDLDGLQGHREFMTEVMCLGKLKHPNLVKLIGYCCEEAHRLLVYEFMPRGSLESQLFRRCSLPLPWTTRLNIAYEAAKGLQFLHEAEKPIIYRDFKASNILLDSDYTAKLSDFGLAKDGPQGDDTHVSTRVMGTQGYAAPEYIMTGHLTAKSDVYSFGVVLLELLTGRKSVDIARSSRKETLVEWARPMLNDARKLGRIMDPRLEDQYSETGARKAATLAYQCLRYRPKTRPDISTVVSVLQDIKDYKDDIPIGIFTYTVPTKPRREVKETSLQNFDKPRQTSLQNFDKPRNVSTTDNHQKFRSPAHTARNHRITLRNGYNSPMRNEAGGERY

SEQ ID NO: 11777 - protein, 496 aa, Arabidopsis thaliana
MEIIIISLCLATILAFLLLKPLLNRTVAKDNLPPSPWRVPVIGNLHQLSLHPHRSLRSLSHRYGPLMLLHFGRVPILVVSSSDVAHDLMKTHDLKVANRPRLKVIETILNGGREVVFSPYGDYWRQIKTVCVVHLLNKKMVQSFAKVREEERSVMMEKVEKASSDSSPLNLSKLLITLTSDVASRVSFGKKHSNEASMSDFKNQVRKITELVGGFPVSEYIPCLAWIDQIRGLYNRAEEVSKIFGDLMDKVVQEHLDATNKPTKDFVDILLSFERQSKDGIEVRRSDIKFIILDIFLGGTTTTNSLLEWTMTELIRHPECMKKLQDEIRGDATNLTIYRSHEEVEDMKYLKAVIKEGLRLHPPFPLLVLRLLTQDVKLKGYDIAAGTQVITNAWAIQRDIVTWGIDAEEFRPERHLDSPLDFRGTNFEYIPFGSGRRICPGIGFAMALVEVTLANLVNRFNWRMDARLSGDEYDLAEATGIDVCRKFPLIVFPSNA

SEQ ID NO: 11778 - protein, 497 aa, Arabidopsis thaliana
MEMIIISLCLATILALLLLKQFLNRTYTAKVNLPPSPWRVPVIGNLHQLSLHPHRSLRSLSHRYGPLMLLHFGRVPVLVVSSSDVAHDLMKTHDLKVANRPQLKVVEKIFNGGREMVFSPYGEYWRQIKSVCIVNLLNKKKVQSFEKVREEEISEMMERVEKASSDSSPLNLSELLLTLTSDVTSRVSLGRKYSKEESMSDFKIQMRKITELVGGFPVGEYIPCLAWIDKLRGVDEKAEEVSKAFGDLMEKVLQEHLDATDKPTLDFVDVLLSLERHERNGVQIRRSDIKFLILDMFLAGTETTYALLEWIMTELIRHPECMKKLQDEIRAKATKLILYISEEDVEDMKYLKAVVKEVLRLHPPLPLLVPRELSEDIKLKGYDIAAGTQVIINAWAIQRDTMTWGIDAEEFRPERHLDSLVDFRGTNFEFIPFGSGRRICPGIGFAMALVEVTLANLVNRFNWRMEVQHSGDEYDLAESTGLDVCRKFPLIVFPSPA

SEQ ID NO: 11779 - protein, 496 aa, Arabidopsis thaliana
MSLWYIIVAFVFFSSMIIVRIIRKTKKNLPPGPPRLPIIGNLHQLGSKPHRSMFKLSETYGPLMSLKFGSVSTVVASTPETVKEVLKTFDVECCSRPNMTYPARVTYNLKDLCFSPYSKYWREVRKMTVVELYTAKRVQSFQHTRKEEVAALVDFIKQAASLEKPVNLNKKLMKLSGSVICRVAFGINLQGSKLENTYEEVIQGTVELVGSFAAADYFPVVGRIIDRITGLHSKCEKLFKAMDAFFDQSIKHHLEDEIIKDDIIDLLLKMERGETTLGEFQLTRDHTKGILANILNAGIDTSAQVMTWVMTYLISNPRVLKKAQAEVREVIKHKDDIIEEDIERLQYLKMVIKETFRINPLVPLLIPREASKDVKIGGYNIPKKTWIHVNIWAIHRNPNVWKDPEAFIPERFMDSQIDYKGLNFELLPFGSGRRICPGIGMGMALVHLTLINLLYRFDWKLPEGMKVADVDLEESYGLVCPKKIPLQLIPVLTQWT

SEQ ID NO: 11780 - protein, 496 aa, Arabidopsis thaliana
MSLWYIIVVFVFFASIFIAKNTRKTKKNLPPGPPRLPIIGNLHQLGSKPHRSMFKLSEKYGPLVYLKLGKVPSVVASTPETVKDVLKTFDKDCCSRAFLTYPARISYNLKDLAFAPYSKYWKAVRKMTVVELYTAKRVKSFRNIREEEVASFVEFIKHSASLEEIVNLNQTLVKLSGSVICRVGFGINLEGSKLENTYEEVIHGTMEVLGSFAASDYFPVIGGIIDRITGLHNKCEKVFKGTDSFFDHCIKHHLEDGGSKDDIVDLLLKVERGEIGLGEFQFTRNHTKGILLDILLAGVDTSGHTITWVMTHLIKNPRVMKKAQAEVREVIKNKDNITEEDIEGLEYLKMVVKETLRINPLVPLLTPREASKDVKIGGYNIPKKTWIHVNIWAIHRNPNVWKDPEAFIPERFMDNQIDYKGLNFELLPFGSGRRICPGIGMGMALIHLTLINLLYRFDWKLPEGMEVEDVDLEESYGLVCPKKVPLELIPVLTQWT

SEQ ID NO: 11781 - protein, 496 aa, Arabidopsis thaliana
MIWWFIVGASFFFAFILIAKDTRTTKKNLPPGPPRLPIIGNLHQLGSKPQRSLFKLSEKYGSLMSLKFGNVSAVVASTPETVKDVLKTFDAECCSRPYMTYPARVTYNFNDLAFSPYSKYWREVRKMTVIELYTAKRVKSFQNVRQEEVASFVDFIKQHASLEKTVNMKQKLVKLSGSVICKVGFGISLEWSKLANTYEEVIQGTMEVVGRFAAADYFPIIGRIIDRITGLHSKCEKVFKEMDSFFDQSIKHHLEDTNIKDDIIGLLLKMEKGETGLGEFQLTRNHTKGILLNVLIAGVDTSGHTVTWVMTHLIKNPRVMKKAQAEVREVIKNKDDITEEDIERLEYLKMVIKETLRINPLVPLLIPREASKYIKIGGYDIPKKTWIYVNIWAVQRNPNVWKDPEVFIPERFMHSEIDYKGVDFELLPFGSGRRMCPGMGLGMALVHLTLINLLYRFDWKLPEGMNIEDVDLEESYGLVCPKKVPLQLIPVLTQWT

SEQ ID NO: 11782 - protein, 448 aa, Arabidopsis thaliana
MDTRKVKSSSRDAVNCLPDEILAKILSYLPTKRAVSTSLISKRWRNLFALMIQLFESQHHLYLDDSDLVYPEEGKGEMKDVQESFGDFVDKTLTDCNTIKKLSILCPLKCCAHKDIDQWLHHAMERGVVDLDMRFKMGFTPTQNEWPCNVFTIKTLVKLTFRIEVGQNKMPYCPKGVLPVLKSLFLHAIWFACERLCHSMLPGCPILEELFLHDLRGYRYNDSPNFSISHKTLKRLTVHFNNSFELGRPMQFDTPSLLYLEYSGFAPCRYSRTSYLNSLVEVKLDVHIRHECNTHMHLSPIIDWIGNVKTLSLSPASVKMMYSRCVELHVFSNLVKLYFESNEKEGWEVLPRLLNKSPKLETLVLKGLHCASDHGVCVDRNEVKVLEIYGFSGCGREVRQVKCLLREMQFLQVMKVEIDAHDDNKKLRVINHLLDLPKRPSKFHIQFL

SEQ ID NO: 11783 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQAFEVPSANGRYCLVERVVHHSEIVNILRELYPNLPLPERCVDENPYVPTYQVSKDKTRSLGIDYIPLKVSIKETVESLKEKGFAQF

SEQ ID NO: 11784 - protein, 222 aa, Arabidopsis thaliana
MDSDSWSDRLASASRRYQLDFLSRSDNFLGFEEIEGEDDFREEYACPFCSDYFDIVSLCCHIDEDHPMDAKNGVCPICAVKVSSDMIAHITLQHANMFKVTRKRKSRRGGAQSMLSILKREFPDGNFQSLFEGTSRAVSSSSASIAADPLLSSFISPMADDFFISESSLCADTSSAKKTLNQSLPERNVEKQSLSAEDHREKLKQSEFVQGILSSMILEDGL

SEQ ID NO: 11785 - protein, 301 aa, Arabidopsis thaliana
MKLNEEYVKFLGEGAYSFVDLFKYTKSDGSSFHAAVKSSDDENSLLKEFHILSELKGCPRIIQCFGNDLEEGFDDKGNRVYKLLLEYASEGSLSDFMNNCVDRKLPDLMIRDFTRMILQGLVSIHSHGYVHCDLKPENVLVFPCGDSYEVKISDFGLSLQVGEVPDHWKIEYPFVGTLNYMPPESLHDGVANKTLDLWSLGCLVLEMYVCKKPWIGFIPEDFVYILSNGNPPEIPESLPCDARAFIQKCFSRNPKERGTASELLSHRFLRQEKSKLKMISPFNLLKFKKFLNKLLRLKNFL

SEQ ID NO: 11786 - protein, 142 aa, Arabidopsis thaliana
MMINAKTLMKLAKTWQQRAALKRKRISFQRSSITTTSSQTTVEKGCFVVYTADKIRFSFPLSYLSNTIVQELLKISEEEFGLPTEGPITLPFDSVFLEYLIKLIQRRMDEDTEKALLWSISSARCSLQPQQHCSATQQLLVF

SEQ ID NO: 11787 - protein, 327 aa, Arabidopsis thaliana
MNEVAIKRINRSICNGGVGFGVRKVFGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 11788 - protein, 304 aa, Kluyveromyces lactis
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNPHKGLEMDLVKYFQWQLLQGVAFCHENRILHRDLKPQNLLINNRGQLKLGDFGLARAFGIPVNTFSSEVVTLWYRAPDVLMGSRNYCTLIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 11789 - protein, 323 aa, Arabidopsis thaliana
MEDRVLIKNDVTELIGNTPMVYLNKIVDGCVARIAAKLEMMEPCSSIKDRIAYSMIKDAEDKGLITPGKSTLIEATGGNTGIGLASIGASRGYKVILLMPSTMSLERRIILRALGAEVHLTDISIGIKGQLEKAKEILSKTPGGYIPHQFINPENPEIHYRTTGPEIWRDSAGKVDILVAGVGTGGTVTGTGKFLKEKNKDIKVCVVEPSESAVLSGGKPGPHLIQGIGSGEIPANLDLSIVDEIIQVTGEEAIETTKLLAIKEGLLVGISSGASAAAALKVAKRPENVGKLIVVIFPSGGERYLSTELFESVRYEAENLPVE

SEQ ID NO: 11790 - protein, 440 aa, Arabidopsis thaliana
MDRFSNLPDDVIYHIVSFLSAKEATCLKFVSKNFQNLVTIKRNVVFHHWESFKNFVDGLLAEPASYRIKRFSLKLVSMDFAQYNIVNDCLCNVLKRGVLDLELDINVKEDYILPSDVFTCKTVVRLKLGCGFVIDILPKNALLPALKTLILDSVRFYASDGCAFTRLLSASPVLEELVIDRLNWEHWKGSRFVSSPTLKRLTLRRKEWEPEPETWTDFESVSFDTPSLAYLKYKDVIPYGYPIVNLNSIVEARLTLPREVEYDYWLNRSADPSNLIRGLKNVEILSIKVLHTMDLLFYNFKEAVPVFENLIHLSVTSEADFCWDPLQILLEKSPNLKTLTIEGPLHYNFYEKLDLEAVCECLLGYSFLLSCPIKVLKITEFVGDIGEIVQMKHVLGKLPCLELLEVHVQARRDDKKLQIMADLLMLPRTSSKCKVKVHFS

SEQ ID NO: 11791 - protein, 415 aa, Arabidopsis thaliana
METKRVLSSSGSIDSISPLPDELLSHILSFLPTKRAASTSILSKRWRTLFPLMNHLCASLYLDDTDLLYPERQTEEEYYVIHNSFRNFVDKTLSGCNNNSLKKFSLTYEDDDVQRMCLTTGMMSKALEQGVSDLELYIYMPLMYEPPRLLPDTVFINNTLVKLTLGTELCLGRSPWENLEELYIHHIYIEDRDEEFNIHTAPHYIAHNIKKLTVCYNNDVQAPRILSIYTPNLVYLDYSDYLTCLYNSENHFNDLLEARLDLAFARAGRWGDEHDTCLKIMNSITNVQILHLSCFTVENLATLHFEGSEKEYWQLLCNMIEKSPKLETLVLEGLYGISDCEVGIDGGNMVKVVEIQEYKGRLEELNQVKCFLREMENLEEVKVNTSDEIENKLQLTNDLLALLPKRSSKCNIHVL

SEQ ID NO: 11792 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 11793 - protein, 422 aa, Thermus aquaticus
MEYRDPGGLQPAGGLPRMDPHGALGLPIYAVAAYGFKTLEEGAERFATGEGYVYARQKDPTARALEERLKALEGADYAVALASGQAATFAALLALLRQGDEVVAARGLFRGQEPPKSGGFSARVLGPHGGVRVRYVDPEPDRVREALSPSTRAIFVETLANPALYIPDLEGLASLAEEKGVALIVDNTFGAAGALCRPLRWGAHVVVQSLTKWASGTGSVLGGAVLSRDTALWARYPQFLEKDPRGQVPWEALGGRCYPERVRTLGLSLLGMALSPFHAYLLFQGLETVALRVARMSETAHFLAERLQGHPKVKALRYPGLEGDPAHGRPRKYLSAFGPMLTLDLGSQEAASRFLRAIPLPKAANLGDARTLLVHPWTTTHSRLPEEGRLQAGVTPGLVRVSVGLEAPEDLLGMFREALEVV

SEQ ID NO: 11794 - protein, 470 aa, Salmonella typhimurium
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKCICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 11795 - protein, 320 aa, Pelargonium x hortorum
MEKFPVINLEKLNGEGRAETMDKIKDACENWGFFEVLNHGIPYELLDTVEKMTKEHYKKCMEQRFKEMVTSKGLDGVEAEVEDMDWESTFFLKHLPESNISQVPDLQDNYRKVMKEFALKLENLAEELLDLLCENLGLEKGYLKKAFYGSKGPTFGTKVSNYPPCPKPDLIKGLRAHTDAGGLILLFQDDKVSGLQLLKDGNWVDVPPMHHSIVINLGDQLEVITNGKYKSVEHRVIAQSDGTRMSIASFYNPGSDAVIYPAPALLAKETEEKQVYPKFVFEDYMKLYSGLKFKAKEPRFEVMKAREDNINVTLDPIATS

SEQ ID NO: 11796 - protein, 214 aa, Fritillaria liliacea
PAFAPVPVARDEPVAKPAKVTKAKAPKEKKASIAKKPALHPTYLEMISGAIASLKERTGSSQYAIAKFVEDKHKSHLPANFKKLLLVQLRKLTAAGKLTKVKTSYKISAKPTAAVKPRSAAVKPKSAVAKLKSAAKKVKKAAVKPKPKSAAVKPKAPAVKPKSKPAALKPNTVTKSKTVALKGKTAGRPAKAAKTSVKAAPGKKAAPVALKKAK

SEQ ID NO: 11797 - protein, 214 aa, Fritillaria liliacea
PAFAPVPVARDEPVAKPAKVTKAKAPKEKKASIAKKPALHPTYLEMISEAIASLKERTGSSQYAIAKFVEDKHKSHLPANFKKLLLVQLRKLTAAGKLTKVKNSYKISAKPTAAVKPRSAAVKPKSAVAKLKSAAKKVKKAAVKPKPKSAAVKPKAPAVKPKSKPAALKPNTVTKSKTVALKGKTAGRPAKAAKTSVKAAPGKKAAPVALKKAK

SEQ ID NO: 11798 - protein, 214 aa, Fritillaria liliacea
PAFAPVPVARDEPVAKPAKVTKAKAPKEKKASIAKKPALHPTYLEMISEAIASLKERTGSSQYAIAKFVEDKHKSHLPANFKKLLLVQLRKLTAAGKLTKVKNSYKISAKPTAAVKPRSAAVKPKSAVAKLKSAVKKVKKAAVKPKPKSAAVKPKAPAVKPKSKPAALKPNTVTKSKTVALKGKTAGRPAKAAKTSVKAAPGKKAAPVALKKAK

SEQ ID NO: 11799 - protein, 158 aa, Fritillaria liliacea
EMISEAIASLKERTGSSQYAIAKFVEDKHKSHLPANFKKLLLVQLRKLTAAGKLTKVKNSYKISAKPTAAVKPRSAAVKPKSAVAKLKSAAKKVKKAAVKPKPKSAAVKPKAPAVKPKSKPAALKPNTVTKSKTVALKGKTAGRPAKAAKTSVKAAPG

SEQ ID NO: 11800 - protein, 211 aa, Fritillaria liliacea
PAFAPVPVARDEPAAKPAKAKAPKEKKASVAKKPALHPTYLEMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKPKAPAVNMKSKPAALKPNTVTKSKTVALKGKTAGRPAKAAKTSVKAAPGKKAAPVALKKAK

SEQ ID NO: 11801 - protein, 158 aa, Fritillaria liliacea
EMISEAIAPLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKPKAPAVNMKSKPAALKPNTVAKSKTVALKGKTAGRPAKAAKTSVKAAPG

SEQ ID NO: 11802 - protein, 199 aa, Fritillaria liliacea
PAFAPVPVARDEPAAKPAKAKAPKEKKASVAKKPALHPTYLEMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKPKAPAVNMKSKPAALKPNTVTKSKTVALKGKTAGRPAKAAKTSVKAAPG

SEQ ID NO: 11803 - protein, 211 aa, Fritillaria liliacea
  misc_feature (125)..(125): Xaa can be any naturally occurring amino acid
PAFAPVPVARDEPAAKPAKAKAPKEKKASVAKKPALHPTYLEMISEAIASLKERTGSSQYAIAKFVEDKHKSHLPANFKKLLLVQLRKLTAAGKLTKVKNSYKISAKPTPAAKPKSAAVKPKSTXSKLKSAAKKVKKAAVKPKPKSAAVKPKAPAVNMKSKPAALKPNTVTKSKTVALKGKTAGRPAKAAKTSVKAAPGKKAAPVALKKAK

SEQ ID NO: 11804 - protein, 158 aa, Fritillaria liliacea
EMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKPKAPAVNMKSKPAALKPNTVTKSKTVALKGKTAGRPAKAAKTSVKAAPG

SEQ ID NO: 11805 - protein, 170 aa, Fritillaria liliacea
EMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKPKAPAVNMKSKPAALKPNTVTKSKTVALKGKTAGRPAKAAKTSVKAAPGKKAAPVALKKAK

SEQ ID NO: 11806 - protein, 170 aa, Fritillaria liliacea
EMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVKLKAPAVNMKSKPAALKPNTVTKSKTVALKGKTAGRPAKAAKTSVKAAPGKKVAPVALKKAK

SEQ ID NO: 11807 - protein, 170 aa, Fritillaria liliacea
EMISEAIASLKERTGSSQYAIAKFVEDKHKSHLPANFKKLLLVQLRKLTAAGKLTKVKNSYKISAKPTPAAKPKSAAVKPKSTASKLKSAAKKVKKAAVKPKPKSAAVNPKAPAVNMKSKPAALKPNTVTKSKTVALKGKTAGRPAKAAKTSVKAAPGKKAAPVALKKAK

SEQ ID NO: 11808 - protein, 173 aa, Fritillaria liliacea
EMISEAIASLKERTGSSQYAIAKFVEDKHKSHLPANFKRLLLVQLRKLTAARKLTKVKNSYKIPAKPISGSMKTVISVKPKSAVVKPNKSTAVVPDKVAVKPNPKSTVAKPKSKSAAVKPKIAVKSKPVAPMSKTSGGLAKVTKTSVNVTPSTRPKMAAPVAAKKLKIVNKSP

SEQ ID NO: 11809 - protein, 506 aa, Yersinia pseudotuberculosis
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAIEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 11810 - protein, 421 aa, Arabidopsis thaliana
MATETNENLINSFIEITSSSREEANFFLESHTWNLDAAVSTFLDNDAAAAAEPNPTGPPPPSSTIAGAQSPSQSHSPDYTPSETSPSPSRSRSASPSSRAAPYGLRSRGGAGENKETENPSGIRSSRSRQHAGNIRTFADLNRSPADGEGSDSDEANEYYTGGQESGMMVQDPKKVKDVDELFDQARQSAVDRPVEPSRSASTSFTGAARLLSGEAVSSSPQQQQQEQPQRIMHTITFWLNGFTVNDGPLRGFSDPENAAFMNSISRSECPSELEPADKKIPVHVDLVRRGENFTEPPKPKNPFQGVGRTLGASGSGSSSAPQASSAPMNVAPAPSRGLVVDPAAPTTSIQLRLADGTRLVSRFNNHHTVRDVRGFIDASRPGGSKEYQLLTMGFPPKQLTELDQTIEQAGIANAVVIQKF

SEQ ID NO: 11811 - protein, 357 aa, Arabidopsis thaliana
MGKVLEKEAFGLAAKDESGILSPFSFSRRATGEKDVRFKVLFCGICHTDLSMAKNEWGLTTYPLVPGHEIVGVVTEVGAKVKKFNAGDKVGVGYMAGSCRSCDSCNDGDENYCPKMILTSGAKNFDDTMTHGGYSDHMVCAEDFIIRIPDNLPLDGAAPLLCAGVTVYSPMKYHGLDKPGMHIGVVGLGGLGHVAVKFAKAMGTKVTVISTSERKRDEAVTRLGADAFLVSRDPKQMKDAMGTMDGIIDTVSATHPLLPLLGLLKNKGKLVMVGAPAEPLELPVFPLIFGRKMVVGSMVGGIKETQEMVDLAGKHNITADIELISADYVNTAMERLAKADVKYRFVIDVANTMKPTP

SEQ ID NO: 11812 - protein, 192 aa, Blumeria graminis
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCCGLPIILVGCKKDLRHEQKTLEELHKTSQKPVTPEQGEEVRKKIGAYKYLECSAKTNEGVREVFEHATRAALLTKKKKEKRCIIL

SEQ ID NO: 11813 - protein, 481 aa, Arabidopsis thaliana
MARTTRERVKSFINNRWLVFVAAMWIQSCAGIGYLFGSISPVIKSSLNYNQKQLSRLGVAKDLGDSVGFLAGTLSEILPLWAALLVGSVQNLVGYGWVWLIVTGRAPILPLWAMCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRYDTTGCYSSGSACNVSRTHLLCIRMAWSYAHRHTIDWTWLWCSLGHRPSHCL

SEQ ID NO: 11814 - protein, 454 aa, Moraxella catarrhalis
MSVHTPVIPPQNATNDYYLTRQNEMESNVRSYPRKLPLAIAKAQGCWVTDVEGNEYLDCLAGAGTLALGHNHPATINAIKDVLDSGLPLHTLDITTPIKDAFTEKLLSFFPKDFVLQFCGPTGADGTEAAIKLAKTYTGRDNVIAFSGGYHGMTHGSLAMTGNLSAKEKVGNLMAGVQFMPYPHEYRCPLGLGGEAGVDALTYYFENFIEDVESGVVKPAAVILEAIQGEGGVVPAPKKWLQKIREVTTKHDIVLILDEVQAGFARSGKMFAFEHAEIIPDVVVMSKAVGGGLPLAVLAINKKFDAWSPAGHTGTFRGNQLAMAAGYNVLTQITENNLADNARIQGEFLRGELRKAAEQYPCIGHVRGRGLMTGVEIVDERQPADHMGSYPADGELAAAIQKACFDNKLLLERGGRGGTVVRLLCPITITQEECIEVITRFKKAVGEAVKAVRG

SEQ ID NO: 11815 - protein, 430 aa, Shewanella violacea
KLADLLEENREELIALCTREAGKSIQDGIDEVREAVDFCRYYAVQAKKMMAQPELLPGPTGELNELFLQGRGIFVCISPWNFPLAIFLGQVAAALAAGNTVVAKPAEQTSIVGFRAVQLAHQAGIPKDVLQFLPGTGATVGAAITSDERIAGVCFTGSTGTAKLINRTLANREGAIIPLIAETGGQNAMVVDSTSQPEQVVNDVVASSFTSAGQRCSALRVLFLQEDIADRVLEVLKGAMDELSIGNPSSIKTDVGPVIDAMAKANLNAHIDHIKQVGTLLKQLELPAGTDKGHFAAPTAVEIDSIKVLEKEHFGPILHVIRYKASELAKVIDEINSTGFGLTLGIHSRNEGHALKIASKVNVGNVYINRNQIGAVVGVQPFGGQGLSGTGPKAGGPHYLTRFITEKTRTNNITAIGGNATLLSLGDSDE

SEQ ID NO: 11816 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 11817 - protein, 472 aa, Klebsiella aerogenes
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDLSDVKPTGKTVAIIGAGPAGLACADVLTRNGVKAVVFDRHPEIGGLLTFGIPAFKLEKEVMTRRREIFTGMGIEFKLNTEVGRDVQLDDLLKEYDAVFLGVGTYQSMRGGLDNEDAPGVYDALPFLIANTKQIMGFGETADEPYVSMEGKRVVVLGGGDTAMDCVRTSVRQNAAHVICAYRRDEENMPGSKREVKNAREEGVEFQFNVQPLGVEVNANGKVCGVKMARTEMGQPDAKGRRRAEIVPGSEHVVPADAVVMAFGFRPHSMEWLAKHSVELDSQGRIIAPEGSENAFQTSNPKIFAGGDIVRGSDLVVTAIAEGRKAADGILNYLEV

SEQ ID NO: 11818 - protein, 339 aa, Agrobacterium tumefaciens
  misc_feature (339)..(339): Xaa can be any naturally occurring amino acid
MAKTMKAAVVRAFGKPLTIEEVAIPDPGPAEILINYKATGICHTDLHAATGDWPVKPNPPFIPGHEGVGYVAKIGAGVTGIKEGDRAGTPWLYTACGCCIPCRTGWETLCPSQKNSGYSVNGSFAEYGLADPKFVGRLPDNLEFGPAAPVLCAGVTVYKGLKETEVRPGEWVVISGIGGLGHMAVQYAKAMGMHVVAADIYDDKLELAKKLGADFTVNGRAPDAVEQVQKATGGVHGALVTAVSPKAMEQAYGFLRSKGTMALVGLPPGFISIPVFETVLKRITVRGSIVGTRQDLEEALSFAGEGKVAAHFSWDKLENINDIFRRMEEGKIDGRIVLX

SEQ ID NO: 11819 - protein, 477 aa, Lactococcus lactis
MLFLKGLTLMTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 11820 - protein, 475 aa, Fontinalis antipyretica
MSPQTETKAGVGFKAGVKDYRLTYYTPDYQTKETDILAAFRMTPQPGVPAEEAGAAVAAESSTGTWTTVWTDGLTSLDRYKGRCYDLEAVTGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTTLSHYCRDNGLLLHIHRAMHAVIDRQKNHGMHFRVLAKALRLSGGDHIHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTV

SEQ ID NO: 11821 - protein, 475 aa, Glossadelphus ogatae
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVAVEACVQARNEGRDLAREGNEVIREATKWSPELAAACEVWKEIKFEFETIDTL

SEQ ID NO: 11822 - protein, 475 aa, Hypnum tristoviride
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 11823 - protein, 475 aa, Plagiomnium japonicum
MSPQTETKAGVGFKAGVKDYRLTYYTPDYQTKDTDILAAFRMTPQPGVPSEEAGAAVAAESSTGTWTTVWTDGLTSLDRYKGRCYGIEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALYKSQAETGEIKGHYLNATAGTCEEMMKRAYFARELGAPIVMHDYLTGGFTANTTLAHYCRDNGLLLHIHRAMHAVIDRQKNHGMHFRVLAKALRLSGGDHIHAGTVVGKLEGERQVTLGFVDSLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 11824 - protein, 475 aa, Entodon luridus
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTSEEMLKRAQFARELGMPIIMHDYLTGGFTANTSLAHYARDNGLLLHIHRAMHAVIDRQKIHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREATKWSPELAAACEVWKEIKFEFDTIDTI

SEQ ID NO: 11825 - protein, 475 aa, Rhaphidostichum macrostictum
MSPQTETKASVGFKAGVKDYRLNYYTPDYQTKETDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTCEEMLKRAQFARELGMPIIMHDYLTGGFTANTTLAHYARDNGLLLHIHRAMHAVIDRQKIHGMHFRVLAKALRLSGGDHIHAGTVVGKLEGERQVTLGFVDLLRDDYIEKDRSRGIYFTQEWVSLPGVLPVASGGIHVWHMPALTEIFGDDSVLQFGGGTLGHPWGNAPGAVANRVAVEACVQARNEGRDLAREGNEIIREAAKWSPELAAACEVWKEIKFEFDTIDTI

SEQ ID NO: 11826 - protein, 475 aa, Brotherella nakanishikii
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLPRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 11827 - protein, 475 aa, Acanthorrhynchium papillatum
MSPQTETRASVGFKAGVKDYRLNYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTSEEMLKRAQFARELGMPIIMHDYLTGGFTANTSLAHYARDNGLLLHIHRAMHAVIDRQKIHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVAVEACVQARNEGRDLAREGNEIIREAAKWSPELAAACEVWKEIKFEFDTIDTI

SEQ ID NO: 11828 - protein, 475 aa, Trismegistia plicata
MSPQTETKAGVGFKAGVKDYRLNYYTPDYQTSETDILAAFRMTPQPGVPAEEAGAAVAAESSTGTWTTVWTDGLTSLDRYKGRCYDLEPVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMMKRAQCARELGMPIIMHDYLTGGFTANTSLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREAAKWSPELAAACEVWKAIKFEFDTIDTL

SEQ ID NO: 11829 - protein, 475 aa, Trismegistia undulata
MSPQTETKTGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPDLAAACEVWKEIKFEFDTIDTI

SEQ ID NO: 11830 - protein, 366 aa, uncultured crenarchaeote 74A4
MGHWSLILGHGQKNVKESIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIISIPYNNLEGSLKILKKHSKNLAGVIIEPVLGGGGCIPATKEYLKGIQEFVHKNKSLFILDEIVTGFRFRYGCLYPTMKLDPDIVTLGKITGGGMAIGVICGKKEIMEHADTTGKKKSERAYIGGGTFSANPTSMTSGYATLNYLKTNKSTYSKINAIGDYARKELEKVFDGKVVVTGKGSLFMTHFIKNGVTEISNSTDVAKCDSEMLQKYHFKMISKDGIFFLPGKLGAISISHTKEDIEKIILASESF

SEQ ID NO: 11831 - protein, 198 aa, Gossypium barbadense
GQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 11832 - protein, 198 aa, Gossypium barbadense
GQNPLFPRILGHEAGGVVESVGEGVIDVQPGDHVLPIFTGECRECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 11833 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKAVQE

SEQ ID NO: 11834 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAGEGARVCEASRIIGIDLNPNRFEEAKKFGCTEFVNPKDHNKPVQE

SEQ ID NO: 11835 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQE

SEQ ID NO: 11836 - protein, 198 aa, Gossypium hirsutum
GQNPLFPRILGHEAEGVVESVGEGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRSEEAKKFGCTEFVNPKDHNKPVQE

SEQ ID NO: 11837 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNLKDHNKPIQE

SEQ ID NO: 11838 - protein, 198 aa, Gossypium hirsutum
GQNPLFPRILGHEAEGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRFEEAKKFGCTEFVNPKDHNKPVQE

SEQ ID NO: 11839 - protein, 198 aa, Gossypium hirsutum
GQNPLFPRILGHEAEGVVESVGEGVIDVQPGDHVVPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 11840 - protein, 198 aa, Gossypium hirsutum
GQNPLFPRILGHEAEGVVESVGKGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRFEEAKKFGCTEFVNPKDHNKPVQE

SEQ ID NO: 11841 - protein, 198 aa, Gossypium hirsutum
GQNPLFPRILGHEAEGVVESVGEGVIDVQPGDHVLPIFTGECRECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 11842 - protein, 198 aa, Gossypium hirsutum
GQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 11843 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 11844 - protein, 198 aa, Gossypium hirsutum
GQNPLFPRILGHEAEGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAIFGLGAVGLAAAEGARVCEASRIIGIDLNPNRSEEAKKFGCTEFVNPKDHNKPVQE

SEQ ID NO: 11845 - protein, 198 aa, Gossypium hirsutum
GQNPLFPRILGHEAGGVVESVGKGVIDVQPGDHVLPIFTGECKECPHCLSEASNMCDLLRINTERRGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 11846 - protein, 198 aa, Gossypium hirsutum
GQNPLFPRILGHEAEGVVESVGEGVIDVQPGDHVLPIFTGECKECPHCLSEASNMCDLLRINTERRGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQE

SEQ ID NO: 11847 - protein, 198 aa, Gossypium hirsutum
GQNPLFPRILGHEAEGVVESVGKGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 11848 - protein, 198 aa, Gossypium hirsutum
GQNPLFPRILGHEAEGVVESVGEGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 11849 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRFEEAKKFGCTEFVNPKDHNKPVQE

SEQ ID NO: 11850 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNLKDHNKPVQE

SEQ ID NO: 11851 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQE

SEQ ID NO: 11852 - protein, 329 aa, Burkholderia sp. DBT1
MARTIRIRQVGGPEVLQFEELDVGKPGPDELCIRVEAIGLNRAEAIFRAGRYIEPTNLPARLGYEASGVVERVGSGVGGVLPGDAICVIPAFSMNQYGVYAHKAIVPASAVIKRPEGLGAVEAAAVWMAYLTAYGALIDVGKLGKGDAVVIQAASSSVGLAAIQIANSVGAVPIATTRTSTKRSALLDAGAAHVIASLEQDLATEVMRITNGKGARIVFDPVGGPHVEILAQAMSRGGTFFVYGNLSGQPTPFPRWMLKHGQSMRGYLLFEITKDQSRLERACAFISDGLRSGQFKPFIAKTFSFDQMVEAHRYQALNQHIGKIIVTVP

SEQ ID NO: 11853 - protein, 244 aa, Cynodon dactylon
AMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSSPNYLALLVKYAAGDGNIVGVDIKPKGSDEFLPMKQSWGAIWRIDPPKPLKGPFTIRLTSESGGHVEQDDVIPEDWKPDTVYKSKIQF

SEQ ID NO: 11854 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 11855 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRPEEDDRVRMTPHPVEFELYYSV

SEQ ID NO: 11856 - protein, 412 aa, Medicago sativa subsp. x varia
MTELDPSKKVADRYLKREVLGEGTYGVVYKAIDTQTGQTVAIKKIRIGKQKEGVNFTALREIKLLKELKDPNIIELIDCFPHKGNLHLVFEFMETDLEAVIRDRNIFLAPGDIKSYLQMTLKGLAHCHKKWILHRDMKPNNLLIGPNGQLKLADFGLARIFGSPDRRFTHQVFARWYRAPELLFGTKQYGPGVDVWAAACIFAELLLRRPFLQGSSDIDQLGKIFAAFGTPSPSQWPDMVYLPDYVEYQFVPAPPLRSLFPMATDDALDLLSKMFTYDPKDRISVQQALEHRYFTCPPQPTDPVKLPRPAPKKEIKPSDLNPPEGPTVLSPPRKTRRVMPGRDGLEGNSLQGDRVDDNHGNLKQTGGDNTGKNEPAPMSLDFSVFGLKPPNRPTINSADRSHLKRKLDLEFQ

SEQ ID NO: 11857 - protein, 471 aa, Salmonella enterica
MITPIIMAGGNGSRLWPLSRTLYPKQFLCLDGSQSMLQTTITRINNLNASDPIVICNEQHRFIVAEQLKELSKSSGDIILEPVGRNTAPAVALAALKCLKKNALLLVLAADHIIKDEETFCKTIQDARKYAEAGKLVTFGIVPTMPETGYGYIRRGQALFSAENDCSLAFRVAEFVEKPNLETAQSYLDSGEYYWNSGMFLFRADRYIEELKIRPDIYKACSLAMESAVTDLDFIRVDEDSFCACPDESIDYAVMEKTNDAVVVPLNAGWSDVGSWSSLWEISDKDSNGNVTKGDVLSHNADNCYLHAETGLVTAVGVKDLIVVQTKDAVLVANTNCVQDVKKIVEKIKLENRHEHITHREVYRPWGKYDSIDFGERYQVKRITVKPGEGISEQQHYHRAEHWIIVAGTAKITIKGEVKILTENESVYIPVGVKHCLENPGKIALELIEVRSGAYLGEDDIVRFSDKYGRN

SEQ ID NO: 11858 - protein, 418 aa, Rhodococcus sp. Q15
MTAVSEPDTRTVVIVGTGIAGSGAAQALRKEGFGGSIILIGSEPEEPYRRPALSKELLSGKASIDRARLRPSTFWTEQGIDLRIGATVTSIDTDSRTVLLADGDSIDYDVLILATGGRSRRLENEDSERVHYLRDIADMRRLQSQLIEGSSLLVVGGGLIGSEVASTARDLGCSVQVLEAQPVPLSRLLPPSIAEKIAALHASAGVALQTGVDLETLTTGADGVTARARDGREWTADLAVVAIGSLPDTDVAAAAGIAVDNGISVDGYLRTSVVDVYAIGDVANVPNGFLGGMHRGEHWNTAQDHAVAVAKTIVGKEEPFESVPWSWSNQFGRNIQVAGWPGADDTVIVRGDLDSYDFTAICMRDGNIVGAVSVGRPKDIRAVRTLIERSPDISADVLADTNRDLTELAAGLVASPVL

SEQ ID NO: 11859 - protein, 498 aa, Rhodococcus sp. Q15
MAVKDEQAGSGRSKLFRTKSIEQSIKDTDEPETKLRKELNSWDLTVFGVAVVIGAGIFTLTARTAGNVAGPSVSLAFVIAAIACGLAALCYAEFASTVPVAGSAYTFSYATFGEFVAWIIGWDLILEFALASSVVAKGWSLYLGEVMGSRSPIVELGPISFDWGAVLVIAVITILLATGTKLSSRVSLVITAIKVAVVLLVIVVGLFYIDTDNYSPYIPPSEPGSTGEGIHQSLFSYVTGAGGSTFGWYGLLAAASLVFFAFIGFDVVATTAEEAKEPQKALPRGILGSLLIVTVLYVAVTLVLTGMVKYTELEGDTSNLATAFAFHDITWAKNVISFGALAGLTTVVMVLMLGQTRVLFAMARDGLMPRRLAPTGKHGTPVRITILVGVVVAVLAGVFPIGTLEEMVNIGTLFAFVLVSIGVLVLRRTRPDLPRGFRVPLVPLVPILAVLACLWLMFNLSVETWMRFVVWMALGVVIYFAYSRQHSMIGKRERGEIE

SEQ ID NO: 11860 - protein, 431 aa, Mycoplasma conjunctivae
MNKFDIAVIGAGPGGYSLALILAKAGNKVVIFEESFFGGNCVNRGCIPTKTLMKSARIANTLARSKDFGIDSENYYDLQTMFKNVANNSAKLQNAIKGGLTTSNVTIIEASATVIDENTIEANGSQYSFDKLVIASGSRPNFFKIEGAEATNVYTSDDLLTKNPKFDELTIIGGGAISLEFAYFYASFGKKVTIIEAAPQLFANLDESISRAAKAVIAEKGITLYEATKVLRYEDGALILENHDGHIYHKTNNILLAVGRRANNEAFASLNLKFNEKNFIEVNEFFQTSIDHIYAIGDVTGKLMLSTVAYKHGDIVAKHIITGSSDEKFNARFIPWTIYATPEIASVGSSEQQLQAQGIDYEVAEIAASSLPRAHAENAFKLGFIKLIFNKKTFEILGATIFLDEASLLINQIALAIKSKLTILDQYLLVI

SEQ ID NO: 11861 - protein, 460 aa, Arthrobacter globiformis
MADQATAQEFDILVLGGGSGGYAAALRAVQLGLTVGLVEKGKLGGTCLHNGCIPTKALLHSAELADHARDSAKYGVNVTLDSIDINAVNAYKDGIIAGKYKGLQGLIKSKGITVIEGEGKLQGTDTVVVNGTAYKGKNIVLATGSYSRTLPGLEIGGKVITSDQALTMDYIPKSAIILGGGVIGVEFASVWKSFGVDVTIVEGLPSLVPNEDATIVKNFERAFKKRGIKFSTGVFFQGVEQNDDGVKVTLVDGKTFEADLLLVAVGRGPVTANLGYEEAGITIDRGFVITNERLHTGVGNVYAVGDIVPGVQLAHRGYQQGIFVAEEIAGLKPVVVEDINIPKVTYSEPEIATVGYTEKAAKEKFGEDQVQTQEYNLAGNGKSSILGTSGLVKLVRQKDGPVVGVHMIGARMGEQVGEAQLIVNWEAYPEDVAQLLHAHPTQNEALGEAHLALAGKPLHG

SEQ ID NO: 11862 - protein, 361 aa, Schedonorus arundinaceus
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNQALERLERNDVRYRFVVDVAGSNIDDTAA

SEQ ID NO: 11863 - protein, 361 aa, Schedonorus arundinaceus
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASSMVVDQKFVVKIPAGLAPEQAAPLLCAGVTVYSPLKHFGLMTPGLRGGILGLGGVGHMGVKVAKSMGHHVTVISSSDKKRAEAMDDLGADAYLVSSDEAQMAAAMDSLDYIIDTVPVKHPLEPYLALLKMDGKLVLMGVIGEPLSFVSPMVMLGRKTITGSFIGSIEETEEVLRFCVEKGLTSQIEVVKMDYLNQALERLERNDVRYRFVVDVAGSNIDDTAA

SEQ ID NO: 11864 - protein, 361 aa, Schedonorus arundinaceus
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMDAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 11865 - protein, 361 aa, Schedonorus arundinaceus
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGPTSQIEVVKMDYLNHALERLERNDVRYRFVVDVAGSNIKDADA

SEQ ID NO: 11866 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 11867 - protein, 221 aa, Arabidopsis thaliana
MSLTIPANLVLNPRSNKSLTQSVPKSSARFFCSDDKSSSSTPQSMKAFSAAVALSSILLSAPMPAVADISGLTPCKDSKQFAKREKQQIKKLESSLKLYAPESAPALALNAQIEKTKRRFDNYGKYGLLCGSDGLPHLIVNGDQRHWGEFITPGILFLYIAGWIGWVGRSYLIAISGEKKPAMKEIIIDVPLASRIIFRGFIWPVAAYREFLNGDLIAKDV

SEQ ID NO: 11868 - protein, 338 aa, Oryza sativa (japonica cultivar-group)
MRAVVIARAGGPEVLEERDVGEGLPPPGEGEVLVGVSAAGVNRADTVQRQGRYPAPPGASPYPGLECSGTILALGPNVPSRWAVGDQVCALLSSGGYAEKVVVPAGQLLPVPEGVSLTDAAGLPEVACTVWSTVFVTSHLSPSESFLIHGGSSGIGTFAIQIAKHLGIKVFVTAGSEEKLAACKGLGADVCINYKTEDFVARVKEETNGKVTLDMEVYLPGVDVILDNIGGLYLQRNLNSLAVDGRLFIIGFQGGAVTEVNLQPMLARRLTIQAAGLRNRSLDNKALIVSEVEKNVWPAVVQGKVKPVIYKTFPLSEAAEAHKLMEESSHIGKILLIP

SEQ ID NO: 11869 - protein, 470 aa, Arabidopsis thaliana
RMLQVGGPGYATPLAAMSGPSEKLIYVTAVYTGTGIDKPDYLATVDVDPSSPSYSSVIHRLPMPFVGDELHHSGWNSCSSCHGDASVDRRYLVLPSLISGRIYAIDTKENPRAPSLYKYVDPKEIADKTGLAFPHTAHCRTGEILVSCLGDEEGNAKGNGLLLLDSDFNIKNRWEKPDISPLYGYHFWYQPRHKTMISTSWGAPKAFSKGFNLQHVADGLYGSHLHVYSWPGGEIKQLIDLGPTGLLPLEIRFLHDPSKDTGFVGSALSSNMIRFFKNSDETWSHEVVISVKPLKVENWILPEMPGLITDFLISLDDRFIYFVNWLHGDIRQYNIEDPKNPVLTGQIWVGGLLQKGSPVKAVGEDGNTFQFEVPQIKGKSLRGGPQMIQLSLDGKRLYATNSLFSAWVVSFYPEIMEKGSHIIQIDGDTEKGGLTINPDFFVDFGDEPDGPSLAHEMRYPGGDCTSDIWI

SEQ ID NO: 11870 - protein, 487 aa, Lotus corniculatus var. japonicus
MATVLDHGVVNEKKSVNGCCKSGPGYASPIESMSGPRESLIYVTAVYAGTGIEKPDYLATVDVDPSSPTYSKVIHRLPVPYVGDELHHTGWNSCSSCHGDPSAERRFLIAPSLVSGRIYVIDTKTNPRSPSLHKVVDPADIIQKTGLAYPHTSHCLASGELMISCLGDKDGNAEGNGFLLLDSDFNVKGRWEKPGHSPLFGYDFWYQPRHNTMISTSWGAPTAFTKGFDLQHVADGLYGRHLTCIQLARGELRQTLDLGNTGLLPLEIRFLHDPAKDTGFVGSALSSNMIRFFKTQDGSWSHELAIPVKPLKVQNWILPEMPGLITDFLISLDDRFLYFVNWLHGDIRQYNIEDLKNPVLTGQLWVGGLIQKGSPVAAIGEDGKTWQSDVPEIQGQKLRGGPQMIQLTLDGKRLYVTNSLFSAWDKQFYPGLVEKGSHILQIDVDTEKGGLKINPNFFVDFGAEPDGPALAHEMRYPGGDCTSDIWI

SEQ ID NO: 11871 - protein, 488 aa, Medicago sativa
MGTVLQHAVVSEKVNNQQGCCKSGPGYASPLEAMSGPRETLIYVTAVYAGTGIEKPDYLATVDLDPNSPTYSKVIHRLPVPYVGDELHHTGWNSCSSCHGDPSAQRRFLIVPGIVSGRVYVIDTKTNPRAPSLHKVVEPEDISTKTGLAYPHTSHCLASGEIMISCIGDKDGNAEGNGFLLLDSEFNVKGRWEKPGHSPLFGYDFWYQPRHNTMISTSWGAPKAFLQGFNLQHVADGLYGRHLHVYSWPGGEIKQTLDLGDKGLLPLEIRFLHDPAKDTGFVGSALTSNMIRFFKTQDGSWNHEIVISVEPLKVQNWFLPEMPGLITDFLISLDDRFLYFVNWLHGDIRQYNIEDVKNPKLTGQVWAGGLIQKGSPVVAVKDDGETWQSDVPEIQGKKLRGGPQMIQLSLDGKRLYVTNSLFSAWDKQFYPKLVEQGSHILQIDVDTENGGLKINPNFFVDFGAEPDGPSLAHEMRYPGGDCTSDIWI

SEQ ID NO: 11872 - protein, 478 aa, Glycine max
VMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFLRPRDESWSHEVAISVKPLKVQNWILPEMPGLITDFLISLDDRFLYFVNWLHGDIRQYNIEDPKNPVLTGQVWVGDYFQKGSPIVAITEDGNTWQSDVPDIQGNKLSAGPQMIQLSLDGKRVYVTNSLFSAWDKQFYPELVEKGSHMLQIDVDTENGGLKINPNFFVDFGAEPGGPALAHEMRYPGGDCTSDIWI

SEQ ID NO: 11873 - protein, 149 aa, Gossypium hirsutum
SLGAENTAAYVSNVIVSKATLLGTGNGVRIKTWQGGSGYAKNIKFQNILMYNVSNPIIIDQNYCDQEKPCRKQTSAVQVSNVLYQNIRGGTSASNVAMKFDCSQSVPCRQIYLQNVALKAEETKQASSSCANVILSYRGDVSPPCSSRS

SEQ ID NO: 11874 - protein, 457 aa, Escherichia coli
MQKYISEARLLLALAIPVILAQIAQTAMGFVSTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 11875 - protein, 111 aa, Allium cepa
ELQGVVMEIVITFALVYTVYATAADPKKGSLGTIAPIAIGFIVGANILAAGPFSGGSMNPARSFGPAVAAANFAGHWVYWVGPLVGGALAGLVYGDIFIGTSYEPVAQDYP

SEQ ID NO: 11876 - protein, 443 aa, Bacteroides thetaiotaomicron
MKTKYTYKQIWTIAYPILISLIMEQLIGMTDTAFLGRVGEIELGASAIAGVYYLAIFMMAFGFSVGAQILIARRNGEGNYKEIGPIFYQGIYFLVVVAAILFTLSIVFSPFILKNIISSPHIYDAAESYIHWRVYGFFFSFVGVMFRAFFVGTTQTKTLTLNSIVMVLSNVVFNYILIFGKFGFPQLGIAGAAIGSSLAELVSVIFFIIYTWKRIDCKKYALNILPKFQSRTLKRILNVSVWTMIQNFVSLSTWFMFFLFVEHLGERSLAIANIIRNVSGIPFMIAMAFAATCGSLVSNLIGAGEKDCVRGTINQHIRIGYVFVLPILIFFCLFPDLILRIYTDMPDLRDASIPSLWVLCAAYVVLVPANVYFQSVSGTGNTRTALAMELCVLTIYVAYATYFILYLKMDIAFAWTTESVYGIFILLFCYWYMKKGNWQKKQI

SEQ ID NO: 11877 - protein, 466 aa, Myrtus communis
SVGFKAGVKDYKLTYYTPDYETKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIAKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 11878 - protein, 466 aa, Eugenia uniflora
SVGFKAGVKDYKLTYYTPEYETKDTDILAAFRVTPQPGVPPEEAGAAVAAESSTGTWTTVWTDGLTSLDRYKGRCYNIEPVPGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHVHAGTVVGKLEGERDITLGFVDLLRDDFIAKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 11879 - protein, 465 aa, Mouriri guianensis
  misc_feature (216)..(216): Xaa can be any naturally occurring amino acid
  misc_feature (220)..(220): Xaa can be any naturally occurring amino acid
VGFKAGVKDYKLTYYTPDYETKDTDILAAFRVTPQPGVPPEEAGAAVAAESSTGTWTAVWTDGLTSLDRYKGRCYHIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALXKAQXETGEIKGHYLNATAGTCEEMMKRAVFARELGTPIVMHDYLTGGFTANTSLAHYCRDNGLLLHIHRAMHAVIDRQKNHGMHFRVLAKALRMSGGDHIHAGTVVGKLEGEREITLGFVDLLRFDFIEKDRSRGIYFTQDWVSLPGVIPVASGGIHVWHMPALTEIFGDDAVLQFGGGTLGHPWGNAPGAVANRVALEACVQARNEGRDLAREGNEIIREASKWSPELAAACEVWKEIKFEFEAMDTL

SEQ ID NO: 11880 - protein, 465 aa, Calvoa orientalis
  misc_feature (23)..(23): Xaa can be any naturally occurring amino acid
  misc_feature (79)..(79): Xaa can be any naturally occurring amino acid
VGFKAGVKDYRLTYYTPDYQVKXTDTLAAFRVTPQPGVPPEEAGAAVAAESSTGTWTTVWTDGLTSLDRYKGRCYNIEXVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRFDYIEKDRSRGIYFDQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 11881 - protein, 391 aa, unidentified bacterium
EFQTGDVLRISMDENLEGTKEKIAVTYAGLFDDVQVGGQVLFDDGLLGTTVLEKDVANRELVVRVDNDGILGSRKGVNAPGVSINLPGITEKDADDIRFGLDHGINYIAASFVRKPEDVLEIRGLLKEKNMEHVQIVPKIESQEGIDNLDAIIAVSDGLMVPRGDMGVEIPAENVPLVQKEMIRKMNLAGLPVITATQMLDSMEENPRPTRAEASDVANAVFDGTDATMLSGESANGEYPVEAVATMAAIDEKAESSLPYYGRHQDLHFDETDSTEAVASAVSRIAHSVNAKAIVVSTNSGYTACMVSKYRPEVNILAVTYSERVQRGLTLNYGVLPVVYEAPATIDEMIALAKTAVKEQGLANSGDTIVIAAGVPMSQSGTTNMITVQTV

SEQ ID NO: 11882 - protein, 374 aa, Phytophthora infestans
MKVLASTLAILALVAAIANGDDVDQSEVAQQFQGNQDYEVGQVSPASQVGQDSPYQVDQDDTCTLTGTYINGTDVSQCSTIIIDSLSVPAGVMLDLTNVTDGANIKFQGTSTFGTELWAGPLIKLTGNDLTVTGPGTLDGQGSWYWPQGQNITRPVFFRLSRVANSKLSGFTIQNMPFRTFSILSSNYTTISELTIDSRAGNGSAKNTDGFDLSRNNHVTISNNRVYNQDDCLAMQSSSNTIFSNNYCSGSHGISIGSLGGPEQNVNTTVSGLLVKDNTIVNSTNGIRIKTIIGLKGLVTNVTYTNNRLVNVKNAIVMHSDYNKTKGGYSGIPSSLVNITNIKIDGLFGTATNLYDIVANPARCVQLGVQERRC

SEQ ID NO: 11883 - protein, 404 aa, Azoarcus evansii
MDRSSLDLPFFGPEHRALSDAIFDWAAAMPPIDHHDTDAACRRLVAALGRSGFLRYCVPAAFGGALPELDSRALCIARETLAYHDGLADFAFAMQGLGSGAITLAGSPELQRRVLPKVASGEWIAAFALTEPEAGSDVAAMATSARLDGDHYVLDGEKTWISNGGIADVYCVFARTGDAPGTRGLSAFVVHPDMPGFEIAERLDVIAPHPLARLRFNGLRVPVENRLGASGEGFKIAMRTLDIFRASVAAAALGFARRALDEALAHARGRAMFGHTLADFQLTQAKLGEMATDVDAAALLTARAAWQRDVAKKPTTREAAMAKMTATENAQRVIDAAVQMHGGQGVRVGVKVESLYREIRALRIYEGATEVQKLIVARELMKSAARSAPPGSRKASPEGDRHGS

SEQ ID NO: 11884 - protein, 401 aa, Azoarcus evansii
MDRSFLDLPFFGPEHRALSDAMFDWAAAMPPIDHHDTDAACRRLVAALGRAGFLRYCVPAAFGGALPELDSRALCVARETLAYHDGLADFAFAMQGLGSGAITLAGSPELQRRVLPKVASGEWIAAFALTEPEAGSDVAAIATTARADGDHYVLDGEKTWISNGGIADVYCVFARTGDAPGTRGLSAFVVTSDMPGFEVAERLDVIAPHPLARLRFNGLRVPAENRLGASGEGFKIAMRTLDIFRASVAAAALGFARRALDEALTHAQGRAMFGHTLADFQLTQAKLGEMATDIDAAALLTARAAWQRDVAKRPTTREPAMAKMTATENAQRVIDAAVQMHGGQGVRVGVKVESLYREIRALRIYEGATEVQKLIVARELMKQPAPSAARKASPEGDKHGS

SEQ ID NO: 11885 - protein, 268 aa, Pseudomonas aeruginosa PAO1
MSRLQTRFAQLKQENRAALVTFVTAGDPDYASSLEILKGLPAAGADVIELGMPFTDPMADGPAIQLANIRALDGGQTLARTLQMVREFRSGDSETPLVLMGYFNPIHHYGVERFIAEAKEVGVDGLIVVDLPPEHNEDLCHPAQAAGIDFIRLTTPTTGDQRLPTVLEGSSGFVYYVSVAGVTGANAATLEHVEEAVARLRRHTDLPIGIGFGIRSAEHAAAVARLADGVVVGSALIDRIAKARDNAQAVKDVLALCGELAEGVRNAR

SEQ ID NO: 11886 - protein, 475 aa, Pseudomonas aeruginosa PAO1
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 11887 - protein, 448 aa, Pseudomonas aeruginosa PAO1
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKGLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 11888 - protein, 320 aa, Pseudomonas aeruginosa PAO1
MDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPDLPGWEALLEGHYADMLALARTVLRALAIALGIEEDFFDRRFEQPVSVFRLIHYPPASARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGDWLTSRFAQTYAYRRGETA

SEQ ID NO: 11889 - protein, 496 aa, Pseudomonas aeruginosa PAO1
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 11890 - protein, 460 aa, Pseudomonas aeruginosa PAO1
MTAQLNPQRDTRDYQQLDAAHHIHAFLDQKALNREGPRVMVRGDGLQLWDNDGKRYLDGMSGLWCTNLGYGRQDLAAAASRQLEQLPYYNMFFHTTHPAVVELSEMLFSLLPDHYSHAIYTNSGSEANEVLIRTVRRYWQILGKPQKKIMIGRWNGYHGSTLGSTALGGMKFMHEMGGMLPDFAHIDEPYWYANGGELSPAEFGRRAALQLEEKILELGAENVAAFVAEPFQGAGGMIFPPQSYWPEIQRICRQYDVLLCADEVIGGFGRTGEWFAHEHFGFQPDTLSIAKGLTSGYIPMGGLVLGKRIAEVLVEQGGVFAHGLTYSGHPVAAAVAIANLKALRDEGVVTRVREETGPYLQRCLREVFGDHPLVGEVQGAGFVAALQFAEDKVTRKRFANENDLAWRCRTIGFEEGVIIRSTLGRMIMAPALVAGRAEIDELIDKTRIAVDRTAREIGVL

SEQ ID NO: 11891 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 11892 - protein, 426 aa, Pseudomonas aeruginosa PAO1
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQAVGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 11893 - protein, 329 aa, Pseudomonas aeruginosa PAO1
MSIEIRNVSKNFNAFKALDDINLDIQSGELVALLGPSGCGKTTLLRIIAGLETPDAGNIVFHGEDVSQHDVRDRNVGFVFQHYALFRHMTVFDNVAFGLRMKPKGERPGESAIKAKVHELLNMVQLDWLADRYPEQLSGGQRQRIALARALAVEPKILLLDEPFGALDAKVRKELRRWLARLHEEINLTSVFVTHDQEEAMEVADRIVVMNKGVIEQIGSPGEVYENPASDFVYHFLGDSNRLQLGNDQHLLFRPHEVSLSRSAVAEHRAAEVRDIRPLGAITRVTLKVDGQDELIEAEVVKDHDSLAGLARGETLYFKPKAFQPVANL

SEQ ID NO: 11894 - protein, 318 aa, Pseudomonas aeruginosa PAO1
MSNDHPQPLDAAEIPRFAGIPTFMRLPAFTDPAALQVGLIGVPWDGGTTNRAGARHGPREVRNLSSLMRKVHHVSRIAPYDLVRVGDLGDAPVNPIDLLDSLRRIEGFYRQVHAAGTLPLSVGGDHLVTLPIFRALGRERPLGMVHFDAHSDTNDRYFGDNPYTHGTPFRRAIEEGLLDPLRTVQIGIRGSVYSPDDDAFARECGIRVIHMEEFVELGVEATLAEARRVVGAGPTYVSFDVDVLDPAFAPGTGTPEIGGMTSLQAQQLVRGLRGLDLVGADVVEVSPPFDVGGATALVGATMMFELLCLLAESAARSA

SEQ ID NO: 11895 - protein, 458 aa, Pseudomonas aeruginosa PAO1
MSVPQRAVQLTEPSEFLKEHPEVQFVDLLIADMNGVVRGKRIERNSLNKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLNHVNDALKACDHAVLLKRLVKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLAAVLAGVHHGLTNKVEPGAPIEGNSYEQMEPSLPNNLRDALRELDESEIMAKYIDPKYIDIFVACKESELEEFEHSISDLEYNWYLHTV

SEQ ID NO: 11896 - protein, 456 aa, Pseudomonas aeruginosa PAO1
MNSQITNAKTREWQALSRDHHLPPFTDYKQLNEKGARIITKAEGVYIWDSEGNKILDAMAGLWCVNVGYGREELVQAATRQMRELPFYNLFFQTAHPPVVELAKAIADVAPEGMNHVFFTGSGSEANDTVLRMVRHYWATKGQPQKKVVIGRWNGYHGSTVAGVSLGGMKALHEQGDFPIPGIVHIAQPYWYGEGGDMSPDEFGVWAAEQLEKKILEVGEENVAAFIAEPIQGAGGVIVPPDTYWPKIREILAKYDILFIADEVICGFGRTGEWFGSQYYGNAPDLMPIAKGLTSGYIPMGGVVVRDEIVEVLNQGGEFYHGFTYSGHPVAAAVALENIRILREEKIIEKVKAETAPYLQKRWQELADHPLVGEARGVGMVAALELVKNKKTRERFTDKGVGMLCREHCFRNGLIMRAVGDTMIISPPLVIDPSQIDELITLARKCLDQTAAAVLA

SEQ ID NO: 11897 - protein, 159 aa, Pseudomonas aeruginosa PAO1
MIDSDGFRPNVGIILANEAGQVLWARRINQEAWQFPQGGINDRETPEEALYRELNEEVGLEAGDVRILACTRGWLRYRLPQRLVRTHSQPLCIGQKQKWFLLRLMSDEARVRMDITSKPEFDGWRWVSYWYPLGQVVTFKREVYRRALKELAPRLLARD

SEQ ID NO: 11898 - protein, 476 aa, Pseudomonas aeruginosa PAO1
MVADIAYLQQSQQEINQLEALFARQRAAYLAQPMPDATQRVQWLKALRDLLFKEQQALIEAIDRDFSARSADETLLAEIMPSLHGIHYAAKRVKKWMKPARRAVGLQFQPASAQVVYQPLGVVGVIVPWNYPLFLSIGPLTGALAAGNRVMIKMSESTPATGRLLKDLLARIFPEDQVAVVLGEVDVGVAFSKLPFDHLLFTGATSVGKHVMRAAAENLTPVTLELGGKSPAIVSDSVPMKDAAERIAFGKSLNAGQTCVAPDYVLVPSRRVEEFVSQYKEVVQGFFPRLSDNPDYTAIINERQLGRLRGYLDDAREKGATLVPLFAEGQQRRLPQTLLLNVSDDMKVMQEEIFGPLLPVIPYERLEDALAYVNQRPRPLALYYFGYDKAQQQRVLHETHSGGVCLNDTLLHVAQDDIPFGGVGPSGMGHYHGHEGFLTFSKAKGVFSKPRFNAARMIYPPYGKSIQKLVYKLFVR

SEQ ID NO: 11899 - protein, 457 aa, Pseudomonas aeruginosa PAO1
MTSDSRPAVLDLIGNTPLVRVTRFDTGPCTLYLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKVQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLA

SEQ ID NO: 11900 - protein, 467 aa, Pseudomonas aeruginosa PAO1
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIVEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 11901 - protein, 455 aa, Pseudomonas aeruginosa PAO1
MIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFDEHPFKRSPATGKRIAVVGAGPAGLSCAHRLAMHGHDVVLFEARTKAGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEHGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 11902 - protein, 393 aa, Pseudomonas aeruginosa PAO1
MATKASFNWEDPLLLDQQLTEEERMVRDSAQQFAQDKLAPRVLEAFRHEQTDPKIFREMGETGLLGATIPEAYGGSGLNYVCYGLIAREVERVDSGYRSMMSVQSSLVMVPIHEFGNEATRQKYLPKLASGEYIGCFGLTEPNHGSDPGSMVTRAKKVDGGYRLSGSKMWITNSPIADVFVVWAKDDEGQIRGFVLEKGWEGLSAPAIHGKVGLRASITGEIVMDNVFVPEENAFPEVRGLRGPFTCLNSARYGISWGALGAAEFCWHTARQYVLDRQQFGRPLAANQLIQKKLADMQTEITLALQGCLRLGRMKDEGTAAVEITSIMKRNSCGKALDIARLARDMLGGNGISDEFGIARHLVNLEVVNTYEGTHDVHALILGRAQTGIQAFF

SEQ ID NO: 11903 - protein, 393 aa, Pseudomonas aeruginosa PAO1
MADALDSLRLMRTQERPAQVFVRGQGSWLWDSDGRAFLDFTQGLAVNCLGHSPSVLVQALARQARELVSAGPGLLNRPVLALAQRLCLATGSDQAYFLTSGAEANEAAIALARKWGRLHRGGAQRIVSTVNSIHGRTPGTLTACGKPAQHGLEGFARVPFNDLDAMAAAIDEETVAVMLEPVQGDAGVIPATLDYLRGIERLCRQRGVLLILDEVQTGIGRCGALLAEELYGVRADIVTLGKGLGAGVPLSALLARGNACCFEPGDQLGTHHGNALMTAAGLAVLNTVLEPGFLEQVREQGTHLRDGLARVARRYGHGPLRGQGLFWGLPLIGQRAPAVVRAAFGEGLLINAPQPHCLRFSPALTVSRANVDEMLRRLERALARVANRHEEVA

SEQ ID NO: 11904 - protein, 387 aa, Pseudomonas aeruginosa PAO1
MTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVEVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 11905 - protein, 369 aa, Pseudomonas aeruginosa PAO1
MAETQGGDVLVSFRGVQKSYDGETLIVKDLNLDIRKGEFLTLLGPSGSGKTTSLMMLAGFETPTAGEILLAGRSINNVPPHKRDIGMVFQNYALFPHMTVAENLAFPLSVRGMSKTDVKERVKRALSMVQLDAFAGRYPAQLSGGQQQRVALARALVFEPQLVLMDEPLGALDKQLREHMQMEIKHLHQRLGVTVVYVTHDQGEALTMSDRVAVFHQGEIQQIEPPRNLYEQPRNTFVANFIGENNRLSGQLLSCDGERCVVGLPRGEKVEALAVNVGQPGEPVTLSIRPERVRLNGASESCVNRFSGRVAEFVYLGDHVRVRLEVCGRDDFFVKQPIAELDPTLSVGDVVPLGWQVEHVRALDPLPAA

SEQ ID NO: 11906 - protein, 224 aa, Pseudomonas aeruginosa PAO1
MQPFAIAPSILSADFARLGEDVDKVLAAGADIVHFDVMDNHYVPNLTIGPMVCSALRKYGVSAPIDVHLMVSPVDRIIGDFIEAGATYITFHPEASQHIDRSLQLIRDGGCKAGLVFNPATPLEVLKYVMDKVDMVLLMSVNPGFGGQKFIPGTLDKLREARALIDASGREIRLEIDGGVNVKNIREIAAAGADTFVAGSAIFNAPDYAEVIRAMHAELAQAHQ

SEQ ID NO: 11907 - protein, 298 aa, Pseudomonas aeruginosa PAO1
MKQIAFIGLGHMGAPMATNLLKAGYLLNVFDLVQSAVDGLVAAGASAARSARDAVQGADVVISMLPASQHVEGLYLDDDGLLAHIAPGTLVLECSTIAPTSARKIHAAARERGLAMLDAPVSGGTAGAAAGTLTFMVGGDAEALEKARPLFEAMGRNIFHAGPDGAGQVAKVCNNQLLAVLMIGTAEAMALGVANGLEAKVLAEIMRRSSGGNWALEVYNPWPGVMENAPASRDYSGGFMAQLMAKDLGLAQEAAQASASSTPMGSLALSLYRLLLKQGYAERDFSVVQKLFDPTQGQ

SEQ ID NO: 11908 - protein, 1060 aa, Pseudomonas aeruginosa PAO1
MFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNQAMKLMGKQFVLGRTISEALKNGRPCREQGYTYSFDMLGEAALTAADAEKYMADYRQAIDTVGAEPQVGPGPRPSISIKLSALHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPKDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTEVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 11909 - protein, 471 aa, Pseudomonas aeruginosa PAO1
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 11910 - protein, 160 aa, Pseudomonas aeruginosa PAO1
MSAFHDLTLQGLDGQDLPLSPFKGKVLLVVNVASKCGLTPQYAGLENLYQTYRERGFAVLGVPCNQFAGQEPGSEADIQSFCSLNYGVSFPMSAKVEVNGSARHPLYRLLAGEGAEFPGDITWNFEKFLLGPDGRVLARFSPRTAPDDPALVQAIEKALG

SEQ ID NO: 11911 - protein, 370 aa, Pseudomonas aeruginosa PAO1
MSAPVEALFQPFRLGALELPTRVVMAPMTRNFSPGGVPNAKVVEYYRRRAAAGVGLIVSEGTTVGHKAANGYPNVPRFYGEDALAGWKQVVDAVHAEGGRIVPQLWHVGSVRRLGVEPDASVPGYGPMEKAKDGKVLVHGMSKADIQEVIAAFAQAARDAQAIGMDGVEIHGAHGYLIDQFFWEGSNQRDDEYGGSLANRSRFAVELVRAVRAAVGADFPIIFRFSQWKQQDYSARLVETPEGLREFLAPLVEAGVDIFHCSTRRFWIPEFEGSELNLAGWTRELTGKPTITVGNVGLDGSEFLQFFGKTDEVAQPASIDGLVERLDKGEFDLVAVGRALLVDPEWAVKVREGRIGDIKPFSREALASLV

SEQ ID NO: 11912 - protein, 472 aa, Pseudomonas aeruginosa PAO1
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 11913 - protein, 406 aa, Pseudomonas aeruginosa PAO1
MSAPHAQVERADFDRYMVPNYAPAAFIPVRGEGSRVWDQSGRELIDFAGGIAVTSLGHAHPALVKALTEQAQRIWHVSNVFTNEPALRLARKLVDATFAERVFLANSGAEANEAAFKLARRYANDVYGPQKYEIIAASNSFHGRTLFTVNVGGQPKYSDGFGPKFEGITHVPYNDLEALKAAISDKTCAVVLEPIQGEGGVLPAQQAYLEGARKLCDEHNALLVFDEVQSGMGRVGELFAYMHYGVVPDILSSAKSLGGGFPIGAMLTTGEIAKHLSVGTHGTTYGGNPLASAVAEAALDVINTPEVLDGVKAKHERFKSRLQKIGQEYGIFDEIRGMGLLIGAALTDEWKGKARDVLNAAEKEAVMVLQASPDVVRFAPSLVIDDAEIDEGLERFERAVAKLVRG

SEQ ID NO: 11914 - protein, 299 aa, Pseudomonas aeruginosa PAO1
MTVQYPTIADCVGNTPLVRLQRLPGETSNTLLVKLEGNNPAGSVKDRPALSMITRAELRGDIRPGDTLIEATSGNTGIALAMAAAIKGYKMILIMPDNSTAERKAAMTAYGAELILVSKEEGMEGARDLADKLQREGRGKVLDQFANGDNPEAHYHSTGPEIWQQTGGSITHFVSSMGTTGTIMGVSRYLKEQNPAVQIVGLQPMEGSAIPGIRRWPQEYLPKIYDASRVDRVVDMHQDEAEDIMRRLAREEGIFCGVSSGGAVAAMLRLSRELENAVLVAIICDRGDRYLSSGVYDPR

SEQ ID NO: 11915 - protein, 365 aa, Pseudomonas aeruginosa PAO1
MTVDHRQWAREAIRIIEADFQRSADTHLIPLETPGLPGVELYFKDESSHPTGSLKHRLARSLFLYALCNGWLRPAAPVIEASSGSTAISEAYFARLLGLPFIAVMPASTSKEKIAQIAFYGGQSHLVEDPTQIYAESERLARESGGHFMDQFTYAERATDWRANNNIAESIFQQMRHEPYPTPTWLISSPGTGGTLATLGRYVRYRQHCTRVLCADAERSVFFDAYVSGDRGLTLDCGSRIEGIGRPRVEASFLPEVIDAMVKVPDAWSLAAMHYLARRLGRRVGGSSGTNLIGALVAARQMVAAGEKGSLVAILCDGGERYATTYYDPVWLARQGYALEPLVEALAACIERGVALPDGLLVAGL

SEQ ID NO: 11916 - protein, 329 aa, Pseudomonas aeruginosa PAO1
MSVESIRIEGIDTPVSRIGLGTWAIGGWMWGGADDATSVETIRRAVESGINLIDTAPVYGFGHSEEVVGKALQGLRDKAVIATKAALEWSDAGIHRNASAARIRREVEDSLRRLKTDRIDLYQIHWPDPLVAHEETAGELERLRRDGKILAIGVSNYSPEQMDGFRQFAPLASVQPPYNLFERAIDADVLPYAERNGIVVLAYGALCRGLLSGRMNAETRFDGDDLRKSDPKFQQPRFAQYLAAVAQLEELARERYGKSVLALAIRWILDRGPTVALWGARKPEQLNGIADAFGWRLDDEAMARIERILAETIQDPVGPEFMAPPSRNA

SEQ ID NO: 11917 - protein, 328 aa, Pseudomonas aeruginosa PAO1
MTAIEIARPGGPEVLVATSRPLPTPGPREVLVEVRAAGVNGPDVLQRKGVYDPPPGASDIPGLEIAGTVRAVGSEVSRFAVGEAVMALIPGGGYAQFAVADERTTLHLPDGLGMEEAAALPETFMTVWVNLFQRGGFKAGETLLVHGGASGIGTAATMLGKAFGAAKIFTTISSEAQREASLRLGADVAIDYTEQDFVEEVLRGTEGRGVDVIVDIVAGDYVTRNYQAAAMNGRIVQIGVIKGKAAEVDLFPMLSKRLVHLGSTLRSRSHDEKGAIIAELERQVWPHVRAGTVRPQVFRTFPLEQARQAHELMDSGQHIGKIVLTSAP

SEQ ID NO: 11918 - protein, 444 aa, Pseudomonas aeruginosa PAO1
MNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALMMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGIAYFLLKPARYAILLWGPVIIYERMPEIGKVASAIVPSAFEVAGLAGPILIGLASDKLFGARRMPACVLSLAALTLSLALFVPAMQSGSLYLVVSLLFMMGVTLYGPDSMISGAAAIDFGTSEAAGTATGFVNGCGSVGAILGGLLPGYFDTLTVFFVFTATALLASLLLVPFWNSRPGACRVEPKAHASGPLLAAGKPR

SEQ ID NO: 11919 - protein, 184 aa, Pseudomonas aeruginosa PAO1
MKPRVLLSVLALAGLPLSGWAADCPELLQGQLTKLRSKESIDLCQRYAGKPLVVVNTASHCGFTPQFKGLEALYQRYKGQGLEVLGVPSDDFKQEAADTAETAKICYGNYGVTFAMTQPQHVRGDEAIPLFRQLAEQSGQAPRWNFYKYVVDRQGRVVAQFSSKTTPDDPQLQAAIEKAIASQP

SEQ ID NO: 11920 - protein, 370 aa, Pseudomonas aeruginosa PAO1
MLFSPYTLGHLTLPNRIVMPPMTRSRAASGEVATALMAEYYSQRAGAGLIVSEGTQISRQGQGYAWTPGIHSAEQVAGWRQVTDAVHAAGGRIFAQLWHVGRVSHTSLQPGNAAPVSSSALVAEGVKVFVDPQGRGAQAGGGEMVQHSAPRALAVEEIREIVADYAQAARNALDAGFDGVELHGANGYLINQFIDSQANARNDQYGGSLENRLRFLREVAEAVTAVVGRERIGVRLAPLTTLQGAVDDTPQATYLAAARLLDEIGVAYIHIAEADWEDAPAMPAAFKEALRIVYRGSLIYSGMYTKARAEEALARGWADLVGFGRPFIANPDLPYRLEHDLALADGDRSTYFGGGAAGYTDYPSLPQAAG

SEQ ID NO: 11921 - protein, 244 aa, Pseudomonas aeruginosa PAO1
MISIKNVSKWYGDFQVLTDCSTEVAKGEVVVVCGPSGSGKSTLIKCVNALEPFQKGDIVVDGTSIADPKTNLPKLRSRVGMVFQHFELFPHLSITENLTIAQIKVLGRSKEEATKKGLALLERVGLKEHAHKHPGQLSGGQQQRVAIARALAMDPVVMLFDEPTSALDPEMVNEVLDVMVQLAHEGMTMMCVTHEMGFARKVANRVIFMDRGQIVEDCEKEEFFGDVSARSERAQQFLAKILPH

SEQ ID NO: 11922 - protein, 477 aa, Pseudomonas aeruginosa PAO1
MNSPALPLSRGLRIRAELKELLTLAAPIMIAQLATTAMGFVDAVMAGRASPHDLAAVALGNSIWIPMFLLMTGTLLATTAKVAQRHGAGDQPGTGPLVRQALWLALLIGPLSGAVLWWLSEPILGLMKVRPELIGPSLLYLKGIALGFPAAALYHVLRCYTNGLGRTRPSMVLGIGGLLLNIPINYALIYGHFGMPKMGGPGCGWATGSVMWFMFLGMLFWVNKASIYRASQLFSRWEWPDRATIGPLVAVGLPIGIAVFAESSIFSVIALLIGGLDENVVAGHQIALNFSALVFMIPYSLGMAVTVRVGHNLGAGLPRDARFAAGVGMAAALGYACVSASLMLLLREQIAAMYSPDPAVIAIAASLIVFSALFQFSDALQVTAAGALRGYQDTRVTMIMTLFAYWGIGLPVGYSLGLTDWFQEPTGPRGLWQGLVVGLTGAAIMLCIRLARSARRFIRQHERLQREDAEAASVLGR

SEQ ID NO: 11923 - protein, 319 aa, Pseudomonas aeruginosa PAO1
MDKNLHQPLGGNEMPRFGGIATMMRLPHVQSPAELDALDAAFVGVPLDIGTSLRSGTRFGPREIRAESVMIRPYNMATGAAPFDSLNVADIGDVAINTFNLLEAVRIIEQEYDRILGHGILPLTLGGDHTITLPILRAIKKKHGKVGLVHVDAHADVNDHMFGEKIAHGTTFRRAVEEDLLDCDRVVQIGLRAQGYTAEDFNWSRKQGFRVVQAEECWHKSLEPLMAEVREKVGGGPVYLSFDIDGIDPAWAPGTGTPEIGGLTTIQAMEIIRGCQGLDLIGCDLVEVSPPYDTTGNTSLLGANLLYEMLCVLPGVVRR

SEQ ID NO: 11924 - protein, 477 aa, Pseudomonas aeruginosa PAO1
MTADKKAKILATLGPATRSRDDIRALVEAGANLLRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 11925 - protein, 296 aa, Pseudomonas aeruginosa PAO1
MAKIGFIGTGIMGKPMAQNLQKAGHSLFLSTHHDAAPADLLEAGAIALANPKEVAQEAEFIIVMVPDTPQVEDVLFRKDGIAEGAGPNKVVIDMSSISPTATKGFAEKIKATGAQYLDAPVSGGEVGAKAATLSIMVGGCPNTFERALPLFQAMGKNITRVGGNGDGQTAKVANQIIVALNIQAVAEALLFAARNGADPAKVREALMGGFASSRILEVHGERMVKGTFDPGFRISLHQKDLNLALAGARELNLNLPNTANAQQVFSTCAAIGGSNWDHSALIKGLEHMANFSIRDE

SEQ ID NO: 11926 - protein, 449 aa, Pseudomonas aeruginosa PAO1
MESTKQEEQGIYAATPPATGLLERLFKLRQHGTTVRTELAAGLTTFITMAYIIFVNPNIMADAGIDHGAAFVATCLAAALGCFLMGLYANWPVGLAPGMGLNAFFTYTVVGTMGYSWQIALGAVFISGVMFMLLTFSRVREWLLNSIPRSLRFAMGAGVGLFLGLIGLKTAGIVVASPATLIKLGHLTSPGPLLAALCFLMIAVLEYRRVFGGILISILSVTLVGWALGLVQYGGVFSAPPSLAPTFLAMDIAGAFNVTMISVILAFLFVHMFDTAGTLMGVAQRAHLVKEDGRIENLSKAMKADSASSVFGGMLGVPPVTSYVESAAGVAAGGRTGLTAVVVGVLFVAAMFFAPLAGMIPAFATAGALIYVAMLMMGGMAHIDWDEHTETIPAIVTVIMMPLTFSVADGIALGFITYVAMKVLTGKHREVSASLYALFVIFVAKFIFL

SEQ ID NO: 11927 - protein, 454 aa, Pseudomonas aeruginosa PAO1
MNFACEQEAQDFLAANPDIELFELFILDANGVPRGKLLHRDELLAVYRSGRPLPSTILGLTMNGEDVEDSGLVWDVGDIDCRAYPLSGSLVRLPWRQIPTAAVQVSMHPSEGLPASVADPRHLLVRTIDALKSEGYHPVMAAELEFYLLDRERDANGRPQPARDADGGRPRATQVYGLRELEQIEPFLADLYAACKAQGLPARTAISEYAPGQVEITLDHGDALAAMDQAIRYKRLVKGIAHKHGMLACFMAKPFDDLAGTGMHLHVSLADEQGHNLFASDDPAGTPLLRQAVGGMLASLLDSLLLFCPNANSYRRFQANSYAPLAQTWGVDNRTVSLRVPGGPASSRHIEHRICGADANPYLAAAALLAGVHRGIREGIDPGAPVEGNGYAQAGKRLPTDWLTALDTLQGSEWAREAFGEPFLGVYLAVKRAEYRQFMGEVGEQDWRWYLTQA

SEQ ID NO: 11928 - protein, 456 aa, Pseudomonas aeruginosa PAO1
MNQRPGTALPSSPVSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYFSAAVVGGVALLFLLLQRNRPEDVGHPPVEPQAASEAVRYAGFRPEGGNGGNGGSLQVLAKVVRNRTVLCLGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTSEAAGTASGFVNGCGSVGAILGGLLPGYFDTYTVFIGFTIAALIATAVLLPHWNSRPGGARESLRNIPSLADFRPIRS

SEQ ID NO: 11929 - protein, 288 aa, Pseudomonas aeruginosa PAO1
MTAVAFLGLGTMGYPMAGHLQREGYDVCVYNRSSAKALRWVEEYAGRRADTPREACAGAELVFCCVGNDDDLRAVALGEQGAFAGMAPGSLFVDHTTASAEVARELSLLAAERELGFLDAPVSGGQAGAVNGALTVMVGGEEAFYRRAEPLLRSYARMVRRMGDVGSGQLTKMVNQICVAGLLQGLAEALHFARCAGLDGEAAMQVIGKGAAQSWQLENRHQSMLAGEFDFGFAVDWMRKDLSILLAEARRNGAQLPVTALVDQFYAEVQAMGGGRWDTSSLIARLRS

SEQ ID NO: 11930 - protein, 478 aa, Pseudomonas aeruginosa PAO1
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLTDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 11931 - protein, 302 aa, Pseudomonas aeruginosa PAO1
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLFSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 11932 - protein, 297 aa, Pseudomonas aeruginosa PAO1
MTADPILTLFLPIALGIIMLGLGLSLTPADFLRVVRYPKPVLVGLVCQIVLLPLACFLIVQGFALEAALAVGMMLLAASPGGTTANLYSHLAHGDVALNITLTAVNSVIAILTMPLIVNLSLQYFMGDGQAIPLQFGKVVQVFVIVLGPVAIGMLVRNRLPAVADRLQKPVKILSALLLLVIILLALAKDWQTFVTYAPVVGLAALAFNLLSLAVGYWVPRLLRLPKAQAVAIGMEIGIHNGTLAIALALSPSLLNNSTMAIPPAIYGVLMFFTAAAFGWWVSRGHQATPAPVTAPD

SEQ ID NO: 11933 - protein, 286 aa, Pseudomonas aeruginosa PAO1
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 11934 - protein, 323 aa, Pseudomonas aeruginosa PAO1
MQHVRLGNSGLKVSRLCLGCMTYGDPAWRPWVLDEERARPFIREALEAGIDFFDSADIYSTGESERILGRALRDFAQREDLVIATKAFFPMSDRPNACGLSRKHLLASVDASLRRLGTDYLDLFVIHRFDPDTPIEETCETLDSLVRVGKVRYLGASSMPAWRFMKMLAFQRHHGLAQFISMQSQYNLIVREDEEDLVPLCREEGIALTPWSPLARGLLAGARSAGTLRTRTDEQAPRWYGGREEVESTLGALEKLAAARGLPPAQLALAWLLGRNGVAAPIVGLSRPHHLEDALAALTLDLAEEECATLEAPLTARARTPRW

SEQ ID NO: 11935 - protein, 162 aa, Pseudomonas aeruginosa PAO1
MHYVTPDLCDAYPELVQVVEPMFSNFGGRDSFGGEIVTIKCFEDNSLVKEQVDKDGKGKVLVVDGGGSLRRALLGDMLAEKAAKNGWEGIVVYGCIRDVDVIAQTDLGVQALASHPLKTDKRGIGDLNVAVTFGGVTFRPGEFVYADNNGIIVSPQALKMPE

SEQ ID NO: 11936 - protein, 506 aa, Pseudomonas aeruginosa PAO1
MIYAAPGTPGAVVTFKPRYGNYIGGEFVPPVKGQYFTNTSPVNGQPIAEFPRSTAEDIDKALDAAHAAAEAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 11937 - protein, 232 aa, Pseudomonas aeruginosa PAO1
MSGLDKRVGSYEEALEGLTDGMTVLAGGFGLCGIPENLIAEIRRRGVRDLTVVSNNCGVDGFGLGVLLEDRQIRKMIASYVGENALFEQQLLSGELEVELTPQGSLAEKIRAGGAGIPAFFTATGYGTPVAEGKEAREFNGRHYILEPAITGDFAIVKGWKADHFGNVVYRHTAQNFNPLVATAGRITVVEVEEIVEPGELDPTQIHTPGIYVDRIIQGRFEKRIEKRTLRA

SEQ ID NO: 11938 - protein, 458 aa, Pseudomonas aeruginosa PAO1
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNKVEPGAPIEGNSYEQLEPSLPNNLRDALRELDDSEILAKYIDPKYIDIFVACKESELEEFEYSISDLEYNWYLHTV

SEQ ID NO: 11939 - protein, 456 aa, Pseudomonas aeruginosa PAO1
MSNPPPTAERTQLRKSLKLWQIVMIGLAYLTPMTVFDTFGIVSGISQGHVPTAYLLALAGVLFTAISYGKLVRQFPTAGSAYTYAQRAINPHVGFMVGWSSLLDYLFLPMINALLAKIYLTALFPEVAPWIWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAGRVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 11940 - protein, 468 aa, Pseudomonas aeruginosa PAO1
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 11941 - protein, 491 aa, Pseudomonas aeruginosa PAO1
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLREKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRTYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQEQGLRYLDVKPEVQRRFNLEVQQGLRHTVWERGCDSWYKTAAGKNTNNWPGYTFVYRWRTRRPELADYDLAR

SEQ ID NO: 11942 - protein, 305 aa, Pseudomonas aeruginosa PAO1
MIYDSLLDLIGGTPVIRLSKLSARLGVSVFAKLESFNPGGSHKARIALWMILDAERKGILVRGKGQTILEPSGGNTGIGLAMAGNILGYRVSLVVPDNYSPDKRQLLELYGAHVVLSDSRKGNNSHGELAIQILLEHPEFVMLNQQRNPANPQAHREATALEILRDFAGQPPPDFFFAGIGTGGHITGVGEVLRNHWPDMAIYGVQPEQCDLLDDRHASHEIQGLSIGIVPEVCNLGIVTGMVGVSKSACLSMIREVLQNDSVSMGLSSAANLVAVLNMASAMPSGARVLTMIYDGVESYMDAFR

SEQ ID NO: 11943 - protein, 482 aa, Pseudomonas aeruginosa PAO1
MNGHARHWIDGAWLDSAQRGQSFDPASGQPIGTYADGGRAEADAAIAAAVRAFEDGPWKDDHALRAKALEEIAAAFERHADALIDLLALENGKIKPEAAFEVGMVPGKLRYYAGLARSERGASGTPRPDVVSLVLREPMGVAGIIVPWNSPVVLMIRSLAPALAAGTTTVVKMPGQTAQTNAMVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFEHEEEGVALANRSEYGLAAGVWTRDVARAFRVARKIRAGTVWINDWAKVYDEFEEGGYRQSGLGRLNGVAALDDFVEYKHISLTTGAA

SEQ ID NO: 11944 - protein, 1100 aa, Pseudomonas aeruginosa PAO1
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAEMDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLAGYRAAAAGLMHAWHGREGEGAALALACLEKAAYELLYEADYRPDWLEVPLAGLAELTEHLLKGKNR

SEQ ID NO: 11945 - protein, 488 aa, Pseudomonas aeruginosa PAO1
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFAEAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKASLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 11946 - protein, 464 aa, Pseudomonas aeruginosa PAO1
MSQILKTSLLIVGGGPGGYVAAIRAGQLGIPTVLVEGAALGGTCLNVGCIPSKALIHAAEEYLKARHYASRSALGIQVQAPSIDIARTVEWKDAIVDRLTSGVAALLKKHGVDVVQGWARILDGKSVAVELAGGGSQRIECEHLLLAAGSQSVELPILPLGGKVISSTEALAPGSLPKRLVVVGGGYIGLELGTAYRKLGVEVAVVEAQPRILPGYDEELTKPVAQALRRLGVELYLGHSLLGPSENGVRVRDGAGEEREIAADQVLVAVGRKPRSEGWNLESLGLDMNGRAVKVDDQCRTSMRNVWAIGDLAGEPMLAHRAMAQGEMVAELIAGKRRQFAPVAIPAVCFTDPEVVVAGLSPEQAKDAGLDCLVASFPFAANGRAMTLEANEGFVRVVARRDNHLVVGWQAVGKAVSELSTAFAQSLEMGARLEDIAGTIHAHPTLGEAVQEAALRALGHALHI

SEQ ID NO: 11947 - protein, 316 aa, Pseudomonas aeruginosa PAO1
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 11948 - protein, 353 aa, Pseudomonas aeruginosa PAO1
MTLQIRGYAAQSASTPLTAHRFERRAPRADDLVIDILYCGVCHSDLHQARNEWHNSLYPLVPGHEIIGRVASVGEAVSGFAVGELVGVGCMVDSCRHCAACSEGLEQYCAEYPTLTYNGRDRHDGLPTFGGYSERIVVSARFVLRIPQGLDPKAAAPLLCAGITSYSPLRHWKVGPGSRVAVVGLGGLGHMGLKFARALGAEVALFTRSPGKEEEARRLGADQVILSTDPQRMAAVAGRFDLILDTVPHQHDLNPYLATLKRDGTLVLVGLLEPLEPAVHGAQLVMGRRSIAGSAIGGIAETQEMLDFCAAHGIACDIEMIEIQQINQAYERMLASDVKYRFVIDMASLQKSF

SEQ ID NO: 11949 - protein, 310 aa, Pseudomonas aeruginosa PAO1
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPGRDPGEVARGWLNPRCRLVFVTHGGAGASVHCTHGSWSRPADTALPLRDTVGAGDTFQAATLAYLRRLDADSPAGLAALSREAIDAMLAFAIRAAAVTCSRVGPDLPFAHEL

SEQ ID NO: 11950 - protein, 469 aa, Pseudomonas aeruginosa PAO1
MHVATSVIEDQPLRATPAEGETLYEFSQSPLLERQSRQESNARSYPRRIPLALKKARGLLVEDVEGRTFIDCLAGAGTLALGHNHPVVIEAIRQVLADELPLHTLDLTTPVKDQFVQDLFGLLPPALAAEAKIQFCGPTGTDAVEAALKLVRTATGRSTILSFQGGYHGMSQGALGLMGNLGPKKPLGAVLSTGVQFLPYPYDYRCPFGLGGEAGVKANLHYLENLLNDPEGGVQLPAAVIVEVVQGEGGVVPADLDWLRGLRRITEQAGVALIVDEIQSGFARTGRMFAFEHAGIVPDVVVLSKAIGGSLPLAVVVYREWLDKWQPGAHAGTFRGNQMAMAAGSAVMRYLKEHDLAAHAAAMGERLAEHLRILQRDYPQLGDIRGRGLMLGVEIVDPQGEADALGHPPTDGALASRVQRECLRRGLILELGGRHGSVVRFLPPLIIGAEQIDEVARRFARALGAALAG

SEQ ID NO: 11951 - protein, 448 aa, Pseudomonas aeruginosa PAO1
MPTPDKNNKIDVQAFIDAQAVSAFQLRVLSLCFLIVAMDGFDTAAIGFIAPALAHDWQLSPAQLSPILGAALAGLALGAFAAGPLADRFGRKSVLLLSVLFFGGWSLASAYAGSVETLALLRFFTGLGLGGAMPNAITLTSEYCPRRHRALMVTAMFCGFTLGSALGGLLAARMVPALGWESVLLLGGGLPLASLPLLWACLPESVRFLARRAPDAARLRRILERLGRLPDGWAGRLELPADESDGTSPLRQILGAELRGGTLLLWATFFMGLLIIYLLTNWLPTLIGGTGFSLGEAATISAMFQLGGTLGALLLGSAMDRFDAHRVLSLAYVGGALFILGIASLYHSFALLALCVAGVGFCISGSQVGANALAADFYPTRSRATGVSWALGLGRIGSIVGSLSGGALLGLGLGFSGILALLVIPALLAAVAVHRLGRRRARPSPTTL

SEQ ID NO: 11952 - protein, 331 aa, Pseudomonas aeruginosa PAO1
MKTRQLGHNGPSVSAIGLGCMGMTDFYTTGGDRQEAIATLHRAVELGLNFFDTADMYGPHSNEELLGEALRGKREQVFLASKFGIVRDPANPRARGVDGSPAYIRRAIEGSLKRLGTDRLDLYYQHRMDPQVPIEDSVGALADLVKAGKIRHIGLSEASAETLERAHRVHPISALQSEYSLWTRDPEDTGVLAACRRLGIAFVPYSPLGRGFLTGTLKRPEDFAADDYRRFSPRFQGENFAKNLKLVDKVGELAAAKGVKPSQLALAWVLAQGDDLIPIPGTKQRRYLEENVAATELRLSAAELAELDAIFPAEAVAGSRYSEEGMRLVNL

SEQ ID NO: 11953 - protein, 324 aa, Pseudomonas aeruginosa PAO1
MSRIFADNAQSIGNTPLVQINRIAPRGVTILAKIEGRNPGYSVKCRIGANMIWDAEASGRLKSGMTLVEPTSGNTGIGLAFVAAARGYKLILTMPASMSLERRKVLKALGAELVLTEPAKGMKGAIQKAEELVAGDPGKYFMPQQFDNPANPAIHEKTTGPEIWNDTEGAVDVLVSGVGTGGTLTGVSRYIKNTRGKPILAVAVEPVTSPVISQTLAGEEVKPAPHKIQGIGAGFVPKNLDLSLVDRVEKIGDDEAKNMALRLMQEEGILCGISSGAAMAAAVRLAEEPNMQGKTIVVILPDSGERYLSSMLFDGLFSEQELTQ

SEQ ID NO: 11954 - protein, 411 aa, Pseudomonas aeruginosa PAO1
MNLFDTLTLPNGSTIPNRLAKAAMEENMADAAQAPSERLMRLYQAWADGGAGLLISGNVMVDSRAMTGPGGVVLEDDAQLEKFRRWARIGRSAGAQFWLQINHPGRQMQANLGQQAWAPSAVPLELGGMSRHFATPKAMDEAMIAEVIQRFARSAGLAERAGFSGVEIHAAHGYLLSQFLSPLSNRRSDAWGGSLENRARLLLEIVRAVRAEVAPGFAVAVKLNSADFQRGGFSADDAREVVRMLDGLGVDLVELSGGSYEAPAMQGEARDGRTLAREAYFVEFARDIRAAARMPVMVTGGIRRRPVAEQVLASGVDMVGIGTALAIEPNLPRDWRAGKDSAPQLRPITWRNKPLASLANMAAVKFQLRKLSRGRATNPRVSPLCALLAQQAGALLQTRRYRRLMRSRAEA

SEQ ID NO: 11955 - protein, 161 aa, Pseudomonas aeruginosa PAO1
MSDSLLSIPCTTIKGEQKTLADFGGKALLVVNTASKCGFTPQYQGLEALWEKYRERGLVVLGFPCNQFGKQEPGDEGEISQFCELNYGVSFPLFRKIEVNGAGAHPLFVSLKKRAPGLLGSQGIKWNFTKFLIGRDGQVVKRYAPTTKPEELSSAIEALLE

SEQ ID NO: 11956 - protein, 369 aa, Pseudomonas aeruginosa PAO1
MSNLLLSPLAVGNLALRNRIVMAPMTRSRAQQPGDVPTALNALYYAQRAGAGLIVSEGTQISHLGQGYAYTPGIYSEAQLAGWRQVTEAVHAAGGLIAAQLWHVGRMSHRSLQAGGEAPIAPSPIQAKAQVFIADGQGGGSMAPADAPREMTLEDIRRVRDEFVRAARNALDAGFDLVELHGANGYLIDQFLASASNRRSDAYGGSLENRARFLLEIVDALVAAVGAERVGLRLSPWGTINDMHDDEPEAMTLYLAEALQRRGIAYLHLAEWEWSGGPAYPQGFRERLRERFRAPLIVCGNYDAERAEAILQAGLADAVAIGRPFIANPDLVERIRLGAPLAEANQARFYGGDAAGYTDYPTLGQSATA

SEQ ID NO: 11957 - protein, 464 aa, Pseudomonas aeruginosa PAO1
MAVYNYDVVILGTGPAGEGAAMNASKYGRKLAVVDSRRVVGGNCTHLGTIPSKALRHSVKQIIEFNTNPMFRQIGEPRWFSFPDVLKSADRVISKQVASRTGYYARNRIDMFTGTASFVDERTVEVVTPSGAVERLVADQFVIATGSRPYRPSDINFNHPRVYDSDTILSLSHTPRRLIIYGAGVIGCEYASIFSGLGVLVDLIDTRDQLLSFLDDEISDALSYHLRNNNVLIRHNEEYERVEGLDNGVILHLKSGKKIKADALLWCNGRTGNTDKLGLENVGIKVNSRGQIEVDENYRTSVSNIFAAGDVIGWPSLASAAYDQGRSAAGNIVESDSWRFVNDVPTGIYTIPEISSIGKNESELTAAKIPYEVGKAFFKGMARAQISNEPVGMLKILFHRETLEILGVHCFGDQASEIVHIGQAIMNQPGELNTLKYFVNTTFNYPTMAEAYRVAAFDGLNRLF

SEQ ID NO: 11958 - protein, 469 aa, Pseudomonas aeruginosa PAO1
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 11959 - protein, 403 aa, Pseudomonas aeruginosa PAO1
MTQDWDAGRLDSDLEGAAFDTLAVRAGQRRTPEGEHGEALFTTSSYVFRTAADAAARFAGEVPGNVYSRYTNPTVRTFEERIAALEGAEQAVATASGMSAILALVMSLCSSGDHVLVSRSVFGSTISLFDKYFKRFGIQVDYPPLSDLAAWEAACKPNTKLFFVESPSNPLAELVDIAALAEIAHAKGALLAVDNCFCTPALQQPLKLGADVVIHSATKYIDGQGRGMGGVVAGRGEQMKEVVGFLRTAGPTLSPFNAWLFLKGLETLRIRMQAHSASALALAEWLERQPGIERVYYAGLPSHPQHELARRQQSGFGAVVSFDVKGGRDAAWRFIDATRMVSITTNLGDTKTTIAHPATTSHGRLSPEDRARAGIGDSLIRVAVGLEDLDDLKADMARGLAAL

SEQ ID NO: 11960 - protein, 365 aa, Pseudomonas aeruginosa PAO1
MADQDQLKALRLRIDSLDEKLLELISERARCAQDVARVKTQTLGEGEAPVFYRPEREAWVLKHIMQLNKGPLDNEEVARLFREIMSSCLALEQPLKVAYLGPEGTFTQAAALKHFGNAVISTPMAAIDEVFREVAAGAVNFGVVPVENSTEGAVNHTLDSFLEHDMVICGEVELRIHHHLLVGETTKTDNITRIYSHAQSLAQCRKWLDSHYPSVERVAVSSNADAAKRVKSEWNSAAIAGDMAASLYDLSKLHEKIEDRPDNSTRFLIIGNQEVPPTGDDKTSIIVSMRNKPGALHELLVPFHNNGIDLTRIETRPSRSGKWTYVFFIDFVGHHKEPLIKDVLEKIGQEAVALKVLGSYPKAVL

SEQ ID NO: 11961 - protein, 264 aa, Pseudomonas aeruginosa PAO1
MNQDNPQAIIQVRDLCNRFGAQAVHEHLDLDVRRGEILGVVGGSGTGKSVLLRSIVGLRRPTSGSVRVFGEDLLQLPEERRSLVERRFGVLFQQGALFSSLTVVENVALPLIENAGLPRADAEHLAQVKLALAGLPANAGDKYPASLSGGMIKRAALARALALDPDILFLDEPTAGLDPIGAAAFDNLIRTLRDALGLTVFLVTHDLDTLYTICDRVAVLSQKKVLVVDTLERVAATDDAWVREYFHGPRGRAAHQAAAVPENH

SEQ ID NO: 11962 - protein, 187 aa, Pseudomonas aeruginosa PAO1
MLKRLLIAACTLLFAGSLLAATPAAKPHVLIATSLGEIEVELDPAKAPISVKNFLEYVDSGYYDGTLFHRVIPGFMVQTGGFSAGMQEKKTRAPIKNEADNGLLNERGTLAMARTGVVDSATSQFFINLTDNDFLNHGARDFGYAVFGKVVRGMGVVDQIAKVPTTRRNGFADVPSDDVVILSAKRL

SEQ ID NO: 11963 - protein, 320 aa, Pseudomonas aeruginosa PAO1
MNALQGIEGRVEWSEIAAPSCGQGEIRIRVAAAGLNRADLLQKAGLYPPPPGASPALGLECAGVVSEVGAGCTWQVGDRVCALLAGGGMAEEVVVDARHVLPVPAGLSLAEAAGIPEVYATAWLNLFQLAALQPGEKVLLHAGASGVGSAGIQLCKAFGNPCWVSVGSAERLAYCESLGAAGGVLRKQSLESLRDFAPFDVILDPVGARYAGLNLELLRRDGRWVIIGLMGGREAQLDLAQLLGKRIQLTGSTLRTRDAEFKAQLIAELGLKVWPLFSAGKLRAQLERTFPIVDAEAAFEALASNQVQGKVVLVVDPSLA

SEQ ID NO: 11964 - protein, 311 aa, Pseudomonas aeruginosa PAO1
MRALTALSRFVSASFPFWVLLFAILAFFRPAWFLPLTAAIAPLLGLVMFGMGLTLKGEDFREVARHPIRVLIGVLAQFVIMPGLAWLLCRLLQLPAEIAVGVILVGCCPGGTASNVMTWLSRGDVALSVAITSVTTLLAPLVTPALVWLLASAWLPVSFAAMFLSILQVVLVPIALGLLAQRLLGERTRQVAEVLPLVSVFSIVVIIAAVVAASQARIAESGLLIMAVVMLHNGFGLLLGYLTGKLTGMPLAQRKALAIEVGMQNSGLGAALANAHFSPLAAVPSALFSVWHNLSGSLLAALFRRLDDTPR

SEQ ID NO: 11965 - protein, 296 aa, Pseudomonas aeruginosa PAO1
MSASLPSLAFAGLGLMGVPMCRRLLAAGYPLAVWNRSPGKRELLAAEGAKAVEVPAELAADAEILMLCLADTAAVREVVFGAGGIVENARPGQLLVDFSSAEPAATREMAAELEARCGVRWVDAPVSGGTPGAESGSLAIMAGGRAADIERLRPVLSRLGQRLTRMGEVGAGQVTKVCNQMIVACNALVIAEVVALAERAGVDASLVAPALAGGFADSKPLQILAPQMAESRYEPVKWHVRTLLKDLDTAVKLSREQGAATPMSGLAAQLMRLHGSQGYLERDPATLVEQYRTAVE

SEQ ID NO: 11966 - protein, 455 aa, Pseudomonas aeruginosa PAO1
MPDAPASAAERLERLPLSPYHRLVFVIIALAFFFDSMDLAMMTFLLGSIKAEFGLDSAQAGLLASSSFFGMVIGAALSGMLADRFGRKPVFQASIVLWGLASYLCSTAGDLDSLTFYRVLLGIGMGMEFPIAQSLLSEMIPASRRGKYIALMDGFWPLGFVAAGCLSYFLLPLTGWRSIFLVLALPAVFVLAIRFLIPESPRWLEQAGRREQADRVLRDIEARVMRSLGLTELPPPLRQPQRERSRPGFFSAFAELWSPAYRRRTLTVWGLWFFALLGFYGLTSWLSALLQQSGFAVTQSVYYTVLISLAGIPGFLCAAWLVESWGRKPSCVLMLLGGGAMAYAYGQTAVFGGSLALLIGFGLAMQFFLFGMWAVLYTYTPELYPTSARATGSGFASAVGRIGSLLGPLVTGLVLPLTGQGGVFTLGALCFGVAALVVWAFGIETRGRTLEELAG

SEQ ID NO: 11967 - protein, 494 aa, Pseudomonas aeruginosa PAO1
MIDLNPIQPICIAGEWRAGGGDLYESLYPATGEAVARLHAASLEDVEEAMAGAHRAFRESGWAQRKPHERATVLYRIAALIRERSEELAQLQRLDNGKPIRETRNLVASAAATFQFFAAACETLEESITPSRGDFVSMSVYEPMGVVVAITPWNSPIASEAQKLAPALAAGNAVVVKPAEITPLAALALARICDEAGLPRGLVSVLPGKGALIGDALTRHPLARRVSFTGGTRTGKHIARIAADKMMPVSLELGGKSPTMVLADADLDHAVAGVLYGIFSSSGESCIAGSRLFVASERYDEFMERLATGAAALRVGDPADERTQMGPLISARHRESVERYVEMGVAEGGRLRTGGLRPHGGAFDRGYFYTPTIIEGLTNGARLCREEVFGPVLVAMPFASEEALIEEANDSCYALAAGIWTRDFQRAWRLGRAVQAGTVWINTYKQFSISTPFGGWRDSGLGREKGRLGILQYMEQKSLYWGLNEQPLAWAGSH

SEQ ID NO: 11968 - protein, 481 aa, Pseudomonas aeruginosa PAO1
MIPVILSGGSGSRLWPLSRKQYPKQFLALTGDDTLFQQTIKRLAFDGMQAPLLVCNKEHRFIVQEQLEAQNLASQAILLEPFGRNTAPAVAIAAMKLVAEGRDELLLILPADHVIEDQRAFQQALALATNAAEKGEMVLFGIPASRPETGYGYIRASADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCEVYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 11969 - protein, 279 aa, Pseudomonas aeruginosa PAO1
MTTAAPTPSLFGQCLAEFLGTALLIFFGTGCVAALKVAGASFGLWEISIIWGVGVSMAIYLSAGVSGAHLNPAVSIALWLFAGFEGRKLPFYITAQVAGAFCAAALVYTLYSSLFIEFEQAQNIVRGSQDSLALASVFSTYPHPALSVGQAFLVEVVITAILMAVIMALTDDGNGLPRGPLAPLLIGLLIAVIGSAMGPLTGFAMNPARDFGPKLMTYLAGWGPIAFTGGREIPYFLVPIFAPILGACLGAGGYRVLIARHLPSAAAPAEAEPEKVRAS

SEQ ID NO: 11970 - protein, 440 aa, Pseudomonas aeruginosa PAO1
MARLKRTLSLGSVVLFGIAYMTPIIVLGTFGILAETTQGHVPAAYIAASLAMLFTALSYGRMAAAFPVAGSAYTYVRKAIDSRLGFIAGWAVLLDYLFLPMAIWLIGAAYLHSAFPAVPNAVWVLAFIGVTTTINIVGLRLAKNVNGLLMLVQFLVLGAFVALCVHYVLGDPGKPLWSLQPLLGGDLQVPLVMSGAAIACYSFLGFDAVSTLTEETRDPRRNIPRAILLITLLGGLIFIVTSYFVQLAHPSFAFDSADSAAYEIARNIGGDLFVTFFLVGLIVGQFTSGLSAQASASRLLFAMGRDGVLPRPFFGRLGKRFETPANSIILCGVVALLALQMDVTTSTSFINFGAFLAFSLVNLSVVFHYYLGAERRGPRETLLFLVFPGIGLVADLWLMASLDHLAIILGLCWLALGAVYLAAITHGFREPPPEMRFEEG

SEQ ID NO: 11971 - protein, 363 aa, Pseudomonas aeruginosa PAO1
MTPPLLEIRNVTRRFGDFTAVDNVSLTINTGEFFTLLGPSGCGKTTLLRMLAGFDQPDSGEIRLNGQDLAGVEPEKRPVHTVFQSYALFPHMSVAQNIAFPLKMAGVAKSEIDARVEQALKDVRLADKGGRMPTQLSGGQRQRVAIARALVNRPRLLLLDEPLSALDAKLREEMQIELINLQKDVGITFVYVTHDQGEALALSHRIAVMNQGRVEQLDAPETIYSFPRSRFVADFIGQCNLLDATVEAVDGERVRIDLRGLGEVQALKSFDAQPGEACVLTLRPEKIRLAQSVTADSDEVHFRGRVAELLYLGDVTLYIVELENGERLETLLPNATPGRAKFFEVGDAVEAAWRFDAGHLVRA

SEQ ID NO: 11972 - protein, 370 aa, Pseudomonas aeruginosa PAO1
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLEKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 11973 - protein, 429 aa, Pseudomonas aeruginosa PAO1
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 11974 - protein, 215 aa, Pseudomonas aeruginosa PAO1
MRVILLGAPGAGKGTQARFITEKFGIPQISTGDMLRAAVKAGSPLGQQVKGVMDSGGLVSDDIIIALIKERITEADCAKGFLFDGFPRTIPQAEALKDAGVTIDHVVEIAVDDEEIVSRIAGRRVHPASGRVYHTEHNPPKVAGKDDVTGEELIQREDDKEETVRHRLSVYHSQTKPLVDFYQKLSAAEGTPKYHSIAGVGSVEQITAKVLSALS

SEQ ID NO: 11975 - protein, 368 aa, Pseudomonas aeruginosa PAO1
MSLLFEPLSLRQITLPNRIAVSPMCQYSAQEGLANDWHLVHLGSRAVGGAGLVIVEATAVLPEGRITADDLGIWSDAHVEPLHRITRFIESQGAVAGVQLAHAGRKASTWRPWLGKHGSVPIGDGGWIPVAPSAIPFDPQHTTPEALSEAQIEALVQAFVRAAERSLAAGFKVAEVHAAHGYLLHQFLSPLSNQRRDQYGGCFENRIRLLLQVTAAVRKAWPQELPLFVRLSATDWVEDGWNPDETVELARHLKDLGVDLIDVSSGGTAANAEIPVGPGYQTEFAERVKKEAGIASGTVGMITEPVQAEHILRTGQADLILLARELLRDPYWPLHAADELRNEQMPWPPQYLRAAHRSTPPRKSLEMQ

SEQ ID NO: 11976 - protein, 489 aa, Pseudomonas aeruginosa PAO1
MLRISQEALTFDDVLLIPGYSEVLPKDVSLKTRLTRGIELNIPLVSAAMDTVTEARLAIAMAQEGGIGIIHKNMGIEQQAAEVRKVKKHETAIVRDPVTVTPSTKIIELLQMAREYGFSGFPVVEQGELVGIVTGRDLRVKPNAGDTVAAIMTPKDKLVTAREGTPLEEMKAKLYENRIEKMLVVDENFYLRGLVTFRDIEKAKTYPLASKDEQGRLRVGAAVGTGADTGERVAALVAAGVDVVVVDTAHGHSKGVIERVRWVKQTFPDVQVIGGNIATAEAAKALAEAGADAVKVGIGPGSICTTRIVAGVGVPQISAIANVAAALEGTGVPLIADGGIRFSGDLAKAMVAGAYCVMMGSMFAGTEEAPGEIELFQGRSYKSYRGMGSLGAMSGSQGSSDRYFQDASAGAEKLVPEGIEGRVPYKGALSAIVHQLMGGLRAAMGYTGSADIQQMRTQPQFVRITGAGMAESHVHDVQITKEAPNYRVG

SEQ ID NO: 11977 - protein, 173 aa, Pseudomonas aeruginosa PAO1
MGKPCHFAQFDLQPAFLVDLDELGQRYRELVRSVHPDRFADAPEREQRLALERAAQLNEAYQTLKSAPRRALYLLTLSGHELPLEATVQDPEFLLQQMQLREELEELQDSADLAGVATFKRRLKAAQAELEREFAACWDDAQRREEAERLVRRMQFLDKLAQEVRQLEERLDD

SEQ ID NO: 11978 - protein, 431 aa, Pseudomonas aeruginosa PAO1
MASLRQKQYSVLGMSTLSFAVNFAVWTMFSIIGIRIKDELGLSESQFGLMVALPILTGSLVRLPLGLITDRFGGRIVFFIHMLLVAIPIYGLAFASQYWHYLVLGLFVGLAGGSFAVGIAYTSAWFEKERQGTAMGIFGAGNAGAAITNLVAPMIVVAFGWRMVPQVYSVAMLVTAVLFWLFTWTDPAHLKGAAEASQRPNLAKQLAPLAELRVWRFGLYYFFVFGGFVALALWLPKYYIAEYGLDLKTASFITMLFTLPSGLIRALGGWFSDHYGARSVNWGVFWVCLVCLFFLSYPQTTMTIHGIQGDLSLGIGLNVWLFTFLVFVVGIAQGFGKASVYRIIHDYYPSNMGTVGGMVGVIGGLGGFCLPILFGYAADHIGVRSSCFMLLFGLTVVCMVWMHYAIKQQRRIDGQAASADVDLPPTLPTHS

SEQ ID NO: 11979 - protein, 427 aa, Pseudomonas aeruginosa PAO1
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 11980 - protein, 506 aa, Pseudomonas aeruginosa PAO1
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 11981 - protein, 482 aa, Pseudomonas aeruginosa PAO1
MSLEQTGHAPATSGIDFESVDADYFQHRQLKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVALALACVAVVAGFLVDPRVVVGAVAIYAVLIGYFALYSRHHLVSGTPEEEFAAIQAAEQDLR

SEQ ID NO: 11982 - protein, 229 aa, Pseudomonas aeruginosa PAO1
MKQYGAEFFGTFWLVLGGCGSAVLAAGVPELGIGYLGVALAFGLSVLTMAYAIGPISGAHLNPAVSVGLWVGGRFPASQLLPYVVAQVLGGLAAGGVLYLIASGKAGFDLAAGFASNGYGEHSPGGYSLQAALVSEVVLTGMFLLIILGATSKRAPQGFAPIAIGLTLTLIHLISIPVTNTSVNPARSTAVALYVGDWAVSQLWLFWVAPILGAVLGALAYRLIGDKND

SEQ ID NO: 11983 - protein, 495 aa, Pseudomonas aeruginosa PAO1
MSIAIDPSVSAFLRSPHGLLIDGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 11984 - protein, 486 aa, Pseudomonas aeruginosa PAO1
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 11985 - protein, 442 aa, Pseudomonas aeruginosa PAO1
MTNPTTSIEDVPLNAFHRLLTLRSGGGSFVDGYVLSIIGVAMLQMTAALQLSSFWQGMIAASALVGIFFGGFLGGWLTDRLGRRRLFFVGPSLFVLASLAQYGVDSAAALFVLRFLIGVAVGIEYPVATALLVEFLPKKYRGPRLATLTILWFAGAAFAYLVGDLILRSGGEDAWRLVLASTAAIGAVLFLLRIGTPESPRWLLSKGRDADAERVIRQVYGEAFSLENLPEQALERKVTIWHLLYAGYGKRMLFVTLFWTCSVIPVFAVYAFAPKVLLALNLKGDWASYGSVAITLLFVIGCIIATRLINRIGRRCMLLHSFLWSGLALLGLGVFHAGSEATILGLFGAYALFIGGAQVLQLVYPNELFPTEIRAFAVGVGTSLSRVGAAVGTYLVPLSLETLGTAQTMYAAALVTLLGLLVTWALAPETRSLNLQQAASLT

SEQ ID NO: 11986 - protein, 496 aa, Pseudomonas aeruginosa PAO1
MTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 11987 - protein, 483 aa, Pseudomonas aeruginosa PAO1
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 11988 - protein, 350 aa, Pseudomonas aeruginosa PAO1
MATLFDPIVLGDLELPNRIVMAPLTRCRADEGRVPNALMAEYYAQRADAGLILSEATAVTPMGVGYPDTPGIWSDDQVRGWSNVTKAVHAAGGRIFLQLWHVGRISDPLYLNGELPVAPSAIAAEGHVSLVRPKRPYVTPRALDTEEIADIVEAYRQGAERAKAAGFDGVEIHGANGYLLDQFLQDSTNKRTDRYGGSIENRARLLLEVTDAAISVWGAQRVGVHLAPRADSHDMGDSNRLETFSHVARELGKRGIAFICAREAQADDSIGVALKKAFGGPYIANEQFTLDSANAILAKGDADAVAFGVPFIANPDLVERLRQGAELNPPRPETFYTGGTEGYLDYPTLA

SEQ ID NO: 11989 - protein, 269 aa, Pseudomonas aeruginosa PAO1
MSTDSAYAVELKGLTFKRGSRAIFDNIDVRIPRGKVTGIMGPSGCGKTTLLRLIASQLRPSKGEVWVNGQNLPQLSRGDLFDMRKQFGVLFQSGALFTDLDVFENVAFPLRVHTQLPEEMIRDIVLMKLQAVGLRGAVELMPDELSGGMKRRVALARAIALDPQILLYDEPFVGQDPIAMGVLVRLIRLLNDALGITSIVVSHDLAETASIADYIYIVGDGRVLGHGTPDVLKETDDPRIRQFVKGIPDGPVPFHYPARDYRADLLGER

SEQ ID NO: 11990 - protein, 453 aa, Pseudomonas aeruginosa PAO1
MAKAKRMYGCTECGATFPKWAGQCADCGAWNTLVETVVEAAPSGSGRGGWAGQQANLKTLAEVSVEEMPRFTTGSTELDRVLGGGLVDGSVVLIGGDPGIGKSTILLQTLCNLASRVPALYVTGEESQQQVAMRARRLSLPEDKLKVMTETSIETIIATARQEQPRVMVIDSIQTIFTEQLQSAPGGVAQVRESAAMLVRYAKQSGTAIFLVGHVTKEGALAGPRVLEHMVDTVLYFEGESDGRLRLLRAVKNRFGAVNELGVFGMTDKGLKEVSNPSAIFLTRAQEAVPGSVVMATWEGSRPMLVEVQALVDTSHLANPRRVTLGLDQNRLAMLLAVLHRHGGIPTYDQDVFLNVVGGVKVLETASDLALMAAVMSSLRNRPLPHDLLVFGEVGLSGEVRPVPSGQERLKEAGKHGFKRAIVPLGNAPKEAPAGLQVIAVTRLEQALDALFE

SEQ ID NO: 11991 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 11992 - protein, 411 aa, Pseudomonas aeruginosa PAO1
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKAMFRADGLLSPQRKVDSLAE

SEQ ID NO: 11993 - protein, 431 aa, Pseudomonas aeruginosa PAO1
MLEKLFQLKAHNTTVRTEILAGITTFLTMAYILFVNPSILGETGMDKGAVFVATCLAAAIGSTIMGLIANYPIALAPGMGLNAFFTYTVVLHMGHSWQVALGAVFISATMFFLLSIFRIREWIINSIPLPLRSAIAAGIGLFLALIALQNAGIVVDNPATLIGMGDLTKPAPILATLGFILIVALEARSVTGAVLIGILVVTAIAILLGVTQFGGVVSMPPSLAPTFLQLDIKGALDIGLVSVIFAFLFVDLFDNSGTLIGVAKRAGLMGKDGHMPKMGRALIADSTAAMGGSLLGTSTTTSYIESAAGVSAGGRTGLTAIVVAILFLLALFFAPLAGSVPAFATAPALLFVAVLMASGLAEIDWEDITVAAPVVVTALAMPFTYSIATGIAFGFISWTAIKVLSGRWRELNPALVILSVLFVIKLGFFNA

SEQ ID NO: 11994 - protein, 251 aa, Pseudomonas aeruginosa PAO1
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 11995 - protein, 377 aa, Pseudomonas aeruginosa PAO1
MAKRDFYEVLGVERGASEADLKKAYRRLAMKYHPDRNPGDKEAEDKFKEANEAYEVLSDASKRAAYDQYGHAGVDPNMGGGAGAGFGGASFSDIFGDVFSDFFGGGGARGGSRGGAQRGADLRYTLDLDLEEAVRGTTVTIRVPTLVGCKTCNGSGAKPGTTPVTCTTCGGIGQVRMQQGFFSVQQTCPRCHGTGKMISDPCGSCHGQGRVEEQKTLSVKVPAGVDTGDRIRLTGEGEAGSMGGPAGDLYVVVNVREHPIFQRDGKHLYCEVPISFADAALGGELEVPTLDGRVKLKIPESTQTGKLFRLRGKGVAPVRGGGAGDLMCKVVVETPVNLDKRQRELLEEFRKSLQSDTSHSPKASGWFEGMKRFFDDL

SEQ ID NO: 11996 - protein, 468 aa, Pseudomonas aeruginosa PAO1
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGLGEAEFLDGLVDEFERKILELGADRVGAFISEPVFGSGGVIVPPAGYHRRMWELCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 11997 - protein, 467 aa, Pseudomonas aeruginosa PAO1
MMESYDVIVIGAGPGGYNAAIRAGQLGLKVACVEGRETLGGTCLNVGCMPSKALLHASELYAAASGGEFARLGIRVSPELDLAQMMKQKDESVAALTRGVEFLFRKHKVQWIKGWARLQGEGRVGVALADGGHAQLEARDIVIATGSEPAPLPGVPVDNQRILDSTGALELVEVPRHLVVIGAGVIGLELGSVWRRLGAQVTVLEYLERICPGLDGETARTLQRALTRQGMRFRLGTRVVAARSGEQGVELDLQPAAGGATESLQADYVLVAIGRRPYTEGLGLETVGLASDRRGMLENQGQRSAAPGVWVIGDVTSGPMLAHKAEEEAIVCIERIAGHAAEMNAEVIPSVIYTQPEVASVGLGEEQLQAARREYKVGRFPFSANSRAKINHESEGFIKILSDARSDQVLGVHMIGPGVSEMIGEACVAMEFSASAEDLALTCHPHPTRSEALRQAAMDVHGRAMQN

SEQ ID NO: 11998 - protein, 489 aa, Pseudomonas aeruginosa PAO1
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWIIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVTATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 11999 - protein, 446 aa, Pseudomonas aeruginosa PAO1
MNRQSAAAVIDAARFNRTHWLILGWGCFIMLFDGYDMVIYGSVVPRLMQEWQLSPVQAGTLGSCALFGMLFGGTLLAPLADRFGRRRLVIATTLLASLAAFLTGHARDPLELGAGRFFTGLALGALVPSAINLISEFAPAGRRSTLVTVMSAFYSVGAVLSALLAIAMIPAWGWQSVFYVAVLPVLAVPLMLRWLPESAAFLELKGRRAELDALLRKVDPDYRPGAERANAVAAEAPSGRVAQLFEGRQAVGTLLLWVAFAMCMLMSYGLNTWLPKLMAGGGYALGSSLAFLVTLNVGATLGALFGGWLADRLGAGRTLVLFFALAAASLAALGLGPGPWLLNGLLVVAGATTIGTLAVIHAYAAQFYPAWVRSTGVGWAAGVGRLGAIAGPMLGGSLLALELPFQQNFLAFAAPGVIGALAIACIHLRPRVPAEASVDATAKKPL

SEQ ID NO: 12000 - protein, 502 aa, Pseudomonas aeruginosa PAO1
MTMTFQHDDLPLALYSAAQVRDLDARLIAAGTPGFELMQRAAHAAWRALRRRWPEAAALTVLAGHGNNAGDGYLIAALAQRAGWRVRVLAVAAPQRLAGDAAQAHAAALATGVVVEPWSECAVLEGVVVDALLGTGLAGAVREPFAQAIRLANAADLPVLAVDIPSGLSADTGAVLGEAIRADLTVTFIGLKIGLFTGEAPARVGELVFDELGSDAVVLQGLQPRAHRLARNALPSLAARPRTAHKGLFGHLLVVGGDTGMGGAVLLAAESALRCGAGLVSAATRVEHVPALLSRCPEVMAHGVASANQLLALAERASVLVLGPGLGQRAWGRSLLSAVRSRPLPQVWDADALNLLALEPVGAGPRTWILTPHPGEAARLLGRSTAEVQADRPAAALELARRYQAVVVLKGAGSLVAAPDGRLAVCSQGHPAMAGAGLGDVLSGITGALLAQRVEAFEAACLAVWLHAAAGERLGAQGRGLAATDLIPTVRQLLEECSPCLK

SEQ ID NO: 12001 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 12002 - protein, 309 aa, Pseudomonas aeruginosa PAO1
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 12003 - protein, 477 aa, Pseudomonas aeruginosa PAO1
MSERLNSDRLNNDFQFIEVGRKDPKKKLLRQRKREFVEIHDLFKPQQAADQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDLSKVKPTGRRVAVIGAGPAGLGCADVLVRNGVTPVVFDRNPEIGGLLTFGIPEFKLEKHVLSRRREVFTGMGIEFRLNTEIGKDVTMEQLLDEYDAVFMGMGTYTYMKGGFPGEDLPGVHDALDFLIANVNRNLGFEKSAEDFVDMKGKRVVVLGGGDTAMDCNRTSIRQGAKSVTCAYRRDEENMPGSRKEVKNAKEEGVKFLFNRQPIAIVGEDRVEGVKVVETRLGEPDARGRRSPEPIPGSEEIIPAEAVLIAFGFRPSPAPWFERFEIATDSQGRVVAPAQAQFKHQTSNPKIFAGGDMVRGSDLVVTAIFEGRTAAEGILDYLGV

SEQ ID NO: 12004 - protein, 134 aa, Pseudomonas aeruginosa PAO1
MKDWLDEIHWNADGLVPAIAQDHETGRVLMMAWMNREALALTASENRAIYWSRSRGKLWRKGEESGHVQKLHELRLDCDADVVILMVEQVGGIACHTGRESCFYRVFENGAWKTVDPVLKDPDAIYEHAGHHHE

SEQ ID NO: 12005 - protein, 467 aa, Pseudomonas aeruginosa PAO1
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 12006 - protein, 257 aa, Pseudomonas aeruginosa PAO1
MAEATPALEIRNLHKRYGDLEVLKGISLTARDGDVISILGSSGSGKSTFLRCINLLENPHQGQILVSGEELRLKKSKNGDLVAADSQQINRLRSELGFVFQNFNLWPHMSILDNVIEAPRRVLGKSKAEAIEIAEGLLAKVGIADKRHSYPAQLSGGQQQRAAIARTLAMQPKVILFDEPTSALDPEMVQEVLNVIRALAEEGRTMLLVTHEMSFARQVSSEVVFLHQGLVEEQGTPQQVFENPQSARCKQFMSSHR

SEQ ID NO: 12007 - protein, 513 aa, Pseudomonas aeruginosa PAO1
MTQANNAVYTDISAAQLVEEAIRRGEGELAANGSLVVRTGHRTGRSPVDRFIVEEPSTKDAIAWGNINRPFPADKFDALWARVEAFNNAQDHFVSHVHVGSAEAYYLPVKMTTATAWQNLFGRCLFIEPEQYNPAGKDEWQVLNVANFECVPERDGTNSDGCVILNFAQKKVLIAGMRYAGEMKKAMFSVQNFLLPERDVLPMHCAANIGEAGDVTLFFGLSGTGKTTLSADESRYLIGDDEHGWGEGVVFNVEGGCYAKCIDLSEKNEPVIWKAIKFGAVLENVVLDEERVPNYADDSLTQNSRAAYPLEHVEKRSEKNLGGEPNAVIFLTCDLTGVLPPVSILNNEQAAYHFLSGYTALVGSTEMGSGGGIKSTFSTCFGAPFFPRPAGVYAELLIKRIKAFGSKVYLVNTGWTGGGYGVGKRFNIPTTRGVIAAIQSGALIGAETEHLEIINLDVPKAVPGVETNLLNPRNTWADKAAYDEAAKGLAKQFIENFKKFEVSDAIKAAGPQL

SEQ ID NO: 12008 - protein, 448 aa, Pseudomonas aeruginosa PAO1
MFGIFRPAPHQAPLPDAEVDSTYRRLRWQIFAGIFIGYAGYYLLRKNFSLAMPYLIEDGYSRGQLGVAMSAIAIAYGLSKFIMGLVSDRSNPRVFLPFGLLVSAAVMFIFGFAHWATSSVAIMFVLLFINGWAQGMGWPPSGRTMVHWWSQKERGSVVSVWNVAHNVGGGLIGPLFLLGLALFGDWRSAFYVPAIVAVGVAVFAYFAMRDTPQSCGLPPIEKHKDDYPEGYDEHHERELSTKEIFVTYVLRNKLLWYIALANVFVYLLRYGVLDWAPTYLKEAKHFNVDKSSWAYFFYEWAGIPGTLLCGWLSDKLFKGNRGATGVVFMILVTVGTLIYWLNPAGNPAIDMAALIMIGFLIYGPVMLIGLQALELAPKKAAGTAAGFTGLFGYLGGSVAANALVGYTVDHFGWDGGFKLLIGACLLAILFLCLTLRKPAVQAAPQQAG

SEQ ID NO: 12009 - protein, 488 aa, Pseudomonas aeruginosa PAO1
MSSPSLVELKAILRLAGPLIAAQLAYVAMVFTDTVMMGKLGPDALAAGGLGAVSYAFVSTFCVGVVAAVGNLVAIRHGCDDAAGAAAAARSGLWVGAALALAAGLLLWNLRPLLLVFGQAPQTVDGAMQFLHSLTFALPGYMAFMVLRGFTSAIDRAGPVMAISVLGALANLALNYSFIEGLFGLPRLGLAGIGLVTALVMNCMPLLLALYIRLQPAYAEYSLLRGLGRPQRAMVEEILRLGLPIGGTYAVESGMFTVATLCMGIIGDHALAAHQIAIQAVYVAFMVPVGLSYATTYRIGQHFGAGRLLEARRAGRVGIGFGALCMLLFAGLFWWMPEAIIGLFLDRDAPANREVAAMAVSLLAIAAWFELFDGTQNVAMGAIRGLKDARTTFLVGLACYWLVGVPLACLLAFAAGWGAAGVWWGLAGGLACAAIGLTLAFEWKTARLLPKATASEASALNCRAAGRGAPSARLCPGNAPVPPTAAAD

SEQ ID NO: 12010 - protein, 497 aa, Pseudomonas aeruginosa PAO1
MTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 12011 - protein, 444 aa, Pseudomonas aeruginosa PAO1
MTMNDEPQSSSLDNFWMPFTANRQFKARPRLLESAEGIHYIAQGGRRILDGTAGLWCCNAGHGRREISEAVARQIATLDYAPPFQMGHPLPFELAARLTEIAPPSLNKVFFTNSGSESADTALKIALAYQRAIGQGTRTRLIGRELGYHGVGFGGLSVGGMVNNRKAFSANLLPGVDHLPHTLDVARNAFTVGLPEHGVEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 12012 - protein, 442 aa, Pseudomonas aeruginosa PAO1
MVGNPALAELLRAPRLIPWRNWSGAQSCLPLAREAPKDLDELVRIIRQASGRIRPVGSGHSFSALVPTDGTLLSLAYFSGLLSHDSVTLQAEFGGGTPMSQMGAPLKEIGQALVNMADIDYQTLAGAIATSTHGTGVGFGSYSAQVRGLQLVTASGEVLECDAKRNVEVFDAARVSLGALGVVTRVRLQNRAAYRLRERQWIARTEELLEDVEKNTRENQHWEMLVVTHSDYALSIALNETDEPKTPPLDPAKEGGNEFVGLIEGLDKYLSDFPETRRTLLNSLRHFARFDERVDDSYAVYANVRNVRFNEMEYSVPAEHGPACLREILALIRDKDLRTWFPIEYRYVKADDIPLSMFEGRDSCSISVHQHYSMDHHNFFAAVEPIFWKYAGRPHWGKLHGLNAHQLQGLYPRWKAFAEVRQALDPRGRFLNAHLSSILGVT

SEQ ID NO: 12013 - protein, 384 aa, Pseudomonas aeruginosa PAO1
MSERAPLVIIGTGLAGYNLAREWRKLDGETPLLMITADDGRSYSKPMLSTGFSKNKDADGLAMAEPGAMAEQLNARILTHTRVTGIDPGHQRIWIGEEEVRYRDLVLAWGAEPIRVPVEGDAQDALYPINDLEDYARFRQAAAGKRRVLLLGAGLIGCEFANDLSSGGYQLDVVAPCEQVMPGLLHPAAAKAVQAGLEGLGVRFHLGPVLASLKKAGEGLEAHLSDGEVIPCDLVVSAVGLRPRTELAFAAGLAVNRGIVVDRSLRTSHANIYALGDCAEVDGLNLLYVMPLMACARALAQTLAGNPSQVAYGPMPVTVKTPACPLVVSPPPRGMDGQWLVEGSGTDLKVLCRDTAGRVIGYALTGAAVNEKLALNKELPGLMA

SEQ ID NO: 12014 - protein, 490 aa, Pseudomonas aeruginosa PAO1
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGKGAYVAPTVFTDCRDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 12015 - protein, 331 aa, Pseudomonas aeruginosa PAO1
MAAKYPLSPAMWRFVEHSRAFASDSPRLDAQRAAYARMCQAFAPPRPAGLRVLDSCLPAAPPVRVRRYRPDRPAPPGGWPALLYLHGGGWMLGGLDSHDFICADLAARLGLLVLAVDYRLAPEHPFPAALQDCLRAWQALSLGELDEALDGRRLLVAGDSAGGNLAAALCLALRDGGAPSPAAQILLYPLLSAAPSPSRIDCADAPLLGLGDVQACLDAYLPLAALHRQPLALPLEAADFTGLPPAFVAVAEFDPLRDDGERYGAALRAAGGEAGFYPGSGLVHGCLRGHGIDEVEALHEALRRAVQGFLAEDSGERQAGEESTAEHQPGE

SEQ ID NO: 12016 - protein, 342 aa, Pseudomonas aeruginosa PAO1
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEVLQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 12017 - protein, 479 aa, Pseudomonas aeruginosa PAO1
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 12018 - protein, 449 aa, Pseudomonas aeruginosa PAO1
MAIEQFGYRQQLRRSLSLSDLIIYGMIFMIPIAPFGVYGWVHADAHGMVPMAYLVGMLAMLFTALSYGAMAKAFPIAGSVYSYAQRGIHPHVGFIAGWVLLLDYLLIPPLLYVFSALALNHLFPAIPKLAWMLLFLVSATLVNLRGITFAARANLLFLIGELVVLAIFLVVGYQALEGGLGNGRLTLEPLYRPEAFDLGLVMKAASIAVLSFLGFDAISTLAEEVKGDPARQIGRAALIALFIMGGIFIAQTWLATDLAAGMNFKSADTAFYEIAEAAGGQWLSMLTAVATALAWGVTVSITSQAAVSRLLYSMARDGRLPRALARVHPRYQTPHVSLYLVAVLSLGIGWAFLDAPDVLTSLVNFGALTGFCLLHLSVINHYYRRQRSGQWLRHLLFPLVGLAIIAYVLYSMSLDAQLLGLAWIAVGLVYLALLQRGGRQAPTELAKDL

SEQ ID NO: 12019 - protein, 455 aa, Pseudomonas aeruginosa PAO1
MHFADPREAREFLAAHPEVRSIELFLIDANGVPRGKLLHRDELLAVYESGRPLPSTILGLTINGDDVEETGLVWDVGDADCWTFPLPGSLTLQPWRQSPTGQVQVSMHPELGLPAAAGDPRHVLQRVIHSLQAEGFHPVMAVELEFYLLDRERDSDGRPLPALQMNGQRPRATQVYGVYELEQLQPFLDDLYAACEAQGLPARTAISEYAPGQVEITLQHRFDTLQAIDEGVRYKRLVKGVANRHGLQACFMAKPFADLSGSGLHLHVSLADAAGNNLFASEDPAGTPLLRQAIGGMKACLLESLALFCPNANSFRRFQANSYAPLAPTWGINNRTVSLRVPGGPASSRHIEHRICGADANPYLAAAALLAAVRLGIRERLDPGAPITGNGYAQATQALPSDWLTALRALEGSAWAREALGEDFLKIYLAIKQAEYRAFMGEVGEQDWRWYLNQA

SEQ ID NO: 12020 - protein, 429 aa, Rickettsia prowazekii str. Madrid E
MTNIESKIKMPRSPYVKKYNSWRIRILYSIVIGYATFYFCRQNFNIATPAIREYFGVTKTQIGWILTAASIMYGVSKACNGFISDKVNARIFMVLGLLFVGIITILIGFSDFLWLIGILWIASNWFQSMGWPPATKMLTHWFAAKELGTKWAIGATSNQIGGALAMISCGYLIDKFDWRAAFFVPGLVACVASLFLYNRLRNSPKEVGLSTVEEYKEYPPEAIGNYERLLTKQLLKMVFCNKLIWYVCLANMFVYIIRSGVIYWAPTFLKDLRNISFVNAGLQIGLYEMIGIPGALIAGILSDKLFQGRRGPIASICMILLTLLLVLFWKVPIQSELLSILILALIGFFVAGPQLLVGIAAADFSTRQAVGTANGLSGLFGYLGAAIAGVGVGWISDNYGWNGVFIFFSISALLGGVLFALTWNHSAEK

SEQ ID NO: 12021 - protein, 252 aa, Rickettsia prowazekii str. Madrid E
MSTKEEFKIKIRSLYKSFAHHKVLDGIDLDVKKGSSLVILGGSGSGKSVLIKSIVGLIKPDKGQIFIDNLEIQDISNTHKFEIMKGVGFLFQGGALFDSLNVRDNITFNTKKLSKKEKNDLAGAKLNSVGLSTRILDLYPSELSGGMQKRVALARAICSTPSILFLDEPTTGLDPIMANVINELIIKIQEELCATTITITHDMISTEKIAKEIAMIYHGKIQWYGSKEEMRNSDNPYLTQFINGLTTGPIEV

SEQ ID NO: 12022 - protein, 370 aa, Rickettsia prowazekii str. Madrid E
MSQDYYQVLGVSKTASQADIKKAYLKLAKQYHPDTTNANDAEKKFKEINAAYDVLKDEQKRAAYDRFGHDAFQSQQARGGGNNGSFHPDINDIFGDFFSDFMGSGRRKQTSSKIRGSDLKYDLTIKLEEAFHGIEKNISFSSEVKCDTCHGTGSEKGETITTCDACGGVGATRIQQGFFTLEQTCHKCQGNGQIIKNPCKKCHGMGRYHKQRNLSINIPAGVENGTRIRHTGEGEAGIRGGNNGDLYVDIAIKPHDIYKVDGANLHCKLPISFVHAALGGEIEVPVIEGGKVKLTIPAGTQNGDQLRLRSKGMSKVRSTIRGDMLTHIHVEVPKNLSKKQRELLEEFKKESINEKENDSSFFNKMKSMWS

SEQ ID NO: 12023 - protein, 161 aa, Rickettsia prowazekii str. Madrid E
MRNSSNKYLDLPYRPGVGMMILNADNQIFVGKRIDTKISSWQMPQGGIVPGETPSIAAMREMLEEIGSNKGYIIAESKCWYSYDVPSFLIPKLWNGNFRGQKQRWFLIRFTGNNKDINIHTSNPEFDQWRWTSLDELLSIIIPFKRKLYQAVVKEFESLIQ

SEQ ID NO: 12024 - protein, 453 aa, Rickettsia prowazekii str. Madrid E
MVIGSGPAGYTGSIRAAQLGLKVACIEKNDTLGGTCLNIGCIPSKALLNTSKKYEEAIRHFDSIGIIADIKLDLQKMLSNKDKIVLDLTKGIESLFIKNKITKIKGEAKIISNNIVEVNKEQIKAKNILITTGSSVIEIPNITIDEEFIVSSTGALKLSKVPKHLIVVGGGYIGLELGSVWRRLGAKVTVVEYASSIVPMLDKEIAKQFMTIQQKQGIEFKLNTKVIASEVKSGKVNLTIEEWDKRSIITSDVVLIAVGRKAYTKNLGFESVGITTDNKGRIEINERFQTAVSNIYAVGDVVKGAMLAHKAEEEAIAAVEIMVGQAGHVNYNLIPSVIYTYPEVASVGATEEQLQEQGINYKVGKFPFLANSRARAIGSTEGMVKILADSKTDRVLGAHIIGSDAGTLIAELIAYMEFGASSEDIARTCHAHPTLSEAIKEAALNVDKRTINI

SEQ ID NO: 12025 - protein, 448 aa, Rickettsia prowazekii str. Madrid E
MTRVTRDKKYYICSNCANISNKWSGQCFDCGVWGSIVEEIINTNKSIIKGSKQTFDKLSCNVSEQLRIPTPICELNRVLGGGLVLGSAILIGGEPGIGKSTLLLQLTASNFESEMRCLYITGEESLDQIKLRAIRLNITNYNTAILAATNLEDIIASIDDNNNNIDLVVIDSIQTITTKELSSPPGTVSQIRTCANELVNYSKQNNIIILLSCHVTKDGQIAGPKILEHLVDTVLYFEGDHNNHFRILRSYKNRFGGVGEIGVFEMSNSGIIEVTNHSELFLIKREHNVVGTSIFAGIEGSRPLLMEVQALIVPSNMVTPRRSAVGWDANRLSMILAVLSSRIGLNLANYEIYLSIAGGLKIADPASDLAVAASLISAATSIPLPEHSVFFGEISLSGEIRKTAKAETRIKEAVKLGFNKVICSKLENLTYDFIFPCAHLQELKEIIK

SEQ ID NO: 12026 - protein, 1152 aa, Rickettsia prowazekii str. Madrid E
MDTNKLYLFKDRRFLPNFIVQLFGCLNDNILKNALVILITYGISGTLSKYNNVLVLITNATFVLPFIIFASIAGQIADKYERANLMKILKIYEIGIIAFAIYGFHHNNLLILFCSIGLMGIHSTFFGPIKYSVLPDHLNKDELLGANGFVEAGTFIGIFIGTIIGSYYTISNNFIIYSLIIIAFLGFITSLFAPKSDNANHNIKINFNIIDESISMIKYSKAKKQIYLAILGISWFWFIGAAIISQIPLLAKITFKADENVANLFLAVFSLGVGVGSFLCSKIFENEITVKYLFISALGISIFGIDLFFASRISSVNYEPTQLKSIFVFLSKRHNWRIVIDLFFLAIIGGLYIVPLFAILQHYANPAHRSRIIAANNLINSIFMVGSTIILSLLFYLNFTIPWIILFISLANIVVTIYIYRLIPEVKIIPFKLLRRIFQICFDLMYKVEVKGFENFQKAGKKVVVVANHISYLDPPLIATYLREEMIFAISPDIQKIWWIKPFLHMAKTLPVDPSNPMAIKTLVKEVQKDQKIAIFPEGRISVTGSLMKIYEGPGMIADKADATLLPVRIDGTQFTHLSKLKNILKKKIFPKITITVLPPVKFANMDTASNQERRSYISRTLYDIMADMMFESSDYKNTLFSSLIEAAKIHGFKKKIVDDFEKNTVTYRDLIFKSFILGDLIKKNNIFGRNLGLMLPNTTNTLITFYAMQSSGYVPAIINWSSAIGTIINCCKLAQIKVVYTSKEFIEKANLHKLITNLLDFGIKIIYLEDLKNQISTALKLKAKIGGYFTQTYYNYFCHNRDEEKPAVIIFTSGTEGEPKAVLLSHRNLQTNRYQITAKVPFSPEDIVFNALPLFHCFGLSGAIITTLNGIKLFLYPHALNYRSIPEAIYDIGATILISTDTFLKGYANYAHPYDFFSLRYIFAGNEKLKETTRQFWLNKYGIRIFEGYGITEAAPIIACNTPMHNKAGTVGRLLPKINYKLEKVAGINEGGRLLIKGPNIMLGYLDLEGQRSHKEWYDTGDIVKIDSEGYITILGRLKRFAKIAEEMISLTRIEEFASEIDPDSLHAAISVQDKRHGEKIILLTTGSDINQENFTNMLSNAQISLLHLPKLIITNSEIPLLASGKIDYIEIMKNINLRDFTHSECCDLDR

SEQ ID NO: 12027 - protein, 213 aa, Rickettsia prowazekii str. Madrid E
MIVIFLGPPGAGKGTQGKKIAKKIDLPHIAVGDIFRTIIKTSTSEAELINNYVKQGALIPNEIVNQVIKVFLLSSKYKNGYILDGYPRNLEQAKFFEAFIQKPQIKIIYFDVADELLIKRVLGRYSCKNCGKIYNIHFLQPKIEHVCDVCSSSVFDYRKDDNKEVIKKRIKVYKTETYPLIDYYKNSGNFYIVNANKNEQEIENDIQKILKIN

SEQ ID NO: 12028 - protein, 459 aa, Rickettsia prowazekii str. Madrid E
MEKYDVAVIGGGPGGYVAAIRAAQLKKKVVLIEKAHLGGVCLNWGCIPTKSLLKSAEVFEYIKHAQDYGIDVGIAEINIKKIVERSRKIANTLACGVQLLLKKNKVTIIDGVASFGENKVINVNDKPTVKAENIIIATGTRPKILQGFEPDIKQIWTSKEAMIPQHVPKSMIIIGSGAIGIEFASFYNSIGVDVTVIEAKNRILPSEDTEIAGIAHKNFEQKGIKIITNAKLIKQTKSQNEIEVELELEGKTQKLQATILLMAVGISANIENLGLEKTKVEVENGYILTNGLMQTAESGIYAIGDVAGVPCLAHKASHEGIIAAESIAGLNPNGINKHNIPYCIYSSPQIASVGLTEEIAKDLGYEIKIGRFPFSANGKALVSGNSDGLIKTIFDVKTGELLGAHMVGLEVTELIQGYVVSKNLEGTELDLINTIFPHPTLSEMMHESVLAAYDMAIHI

SEQ ID NO: 12029 - protein, 480 aa, Chlamydia trachomatis D/UW-3/CX
MAPNTDIGLIGLAVMGKNLVLNMVDHGFSVSVYNRSPAKTEEFLKDHGESGALQGFTTIQEFVQSLKRPRKIMIMIKAGAPVDEMIASLLPFLEEGDILIDGGNSYYLDSEQRYVDLKKEGILFVGMGVSGGEEGARKGPSIMPGGNIDAWPAIAPIFQSIAAQVDGRPCCSWIGTGGAGHFVKAVHNGIEYGDIQLICETYEILKTRLNLSLEQIGNIFFEWNQTDLNSYLIGAAAAVLIAKDENGNAIASTILDVAGQKGTGRWVAEDAIKAGVPMSLIIESVLARYLSTWKEVRTKAAQEFPGIPLLCQPPQEASAFIEDVREALYAAKIISYAQGFMLLKQVSQDKGWDLNLGELALIWRGGCIIQSAFLDKIHQGFENSPEAHSLILQDYFKKVLFDSETGFRRAVLHAIGSGVAIPCLSSALSFYDGYRTVDSSLFLVQGLRDYFGAHGYERRDCPRGEFYHTDWLETKKTFRV

SEQ ID NO: 12030 - protein, 233 aa, Chlamydia trachomatis D/UW-3/CX
MREEAMKKQGVLVAPSIMGADLACIGREARNIEESGADLIHIDVMDGHFVPNITFGPGVVAAINRSTELFLEVHAMIYTPFEFVEAFVKAGADRIIVHFEAAENIKEIISYIQKCGVQAGVAFSPETSIEFVTSFIPLCDVILLMSVHPGFCGQKFIPDTIERIQFVKQAIQVLGREGSCLIEVDGGIDKESARACREAGADILVAASYFFEKDSINMKEKVLLLQGEEHGAK

SEQ ID NO: 12031 - protein, 245 aa, Chlamydia trachomatis D/UW-3/CX
MDRSPLFLIIMGAPGSGKGTQSKLLASQLSLLHISSGDLLRDAVSKDTPLSQEIKSYLDQGKLLPDTLVWKLVHEKLDEFQQDTLLRRLSFLSRSENSAILDGFPRTVTQAKLLHEFLSSYFPNYKVILLDISDEEVLNRLTSRYICPACQGIYNEQQGFSSCPKCSVELIRRSDDTLEVILDRIQTYKQETQPVLDYYTEKQKLITIDANAPTQQVFQSILDSLSASLVYQERDCCNCDCDDED

SEQ ID NO: 12032 - protein, 253 aa, Chlamydia trachomatis D/UW-3/CX
MSKLTQVFKQTKLCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFFEDLLAVGLDPILLISAGTTPERMSLIQEYARGFLYYIPCQATRDSEVGIKEEFRKVREHFDLPIVDRRDICDKKEAAHVLNYSDGFIVKTAFVHQTTMDSSVETLTALAQTVIPG

SEQ ID NO: 12033 - protein, 422 aa, Chlamydia trachomatis D/UW-3/CX
MSHLFSKACQYFPGGVNSPVRACRAVNITPPIVARASKEVFVDSLDKTFIDFCGSWGSLIHGHSHPKICTAIRQGLERGSSYGLTSEQEILFAEEIFSYLGLETNYKIRFMSTGSEATMTAVRLARGITGRPIIIKFLGCYHGHADTFLQEKPFSHTSLETLDLAHPLTLSLPFNDFPLFQTVMNSLGHKVAGVIFEPVCANMGVILPVPGFIEGVIQTCQQTGSFSIMDEVVTGFRVAQGGAAALYHVKPDILVFGKILGGGLPASAVVTPKDIMDHLAPEGKIFQAGTLSGNPLAMIAGKVSVNLCREQGFYTQLATIEQNFLSPIEHMIRTTGIPVTLVRYGSLFSFFFNPNRPNNLADAQLSDIEAFQKFYQSAFSKGVYLSPSPFEASFLSAAHSMESLDYAQTALIESLEQVFSLV

SEQ ID NO: 12034 - protein, 308 aa, Chlamydia trachomatis D/UW-3/CX
MRLFSYDKPKIKVQKIKADGFSGWLKCTHCSEMIHANELGQNFNCCPKCSYHYRISVSERIALLADKDSWNPLFSDLRSQDPLNFVDTDTYPNRLEKARKDNPDSEGVLVGVCTIGSHPVALAVMDFSFMAGSMGAVVGEKLTRLIEKAIDSRLPVIIVSASGGARMQESVFSLMQMAKTSAALAKLHEAKLPYISVLTNPTSGGVTASFASLGDVIIAEPKALICFAGPRVVSQVIGEDLPEGAQKSEFLLEHGMIDKVVERKQLKTTLESLLSFFSCQAYSGGKGNCPRDISKTLKEIFLLTDDNE

SEQ ID NO: 12035 - protein, 454 aa, Chlamydia trachomatis D/UW-3/CX
MTTKIKTQWTCTECGTHSPKWLGQCSGCLQWNTLVEERTAPKLNTSSYSSSSSIPIPLNNVEFQEEIRIHTQAQGWNRLLGGGTVRGSLALLGGEPGIGKSTLLLQISSQFAAAGHKVLYVCGEESVSQTSLRAQRLQISSNNIFLFPETNLEDIKQQIDNIAPDILVIDSIQIIFSPSLSSAPGSVAQVRETTAELMHIAKQKQITTFIIGHVTKSGEIAGPRILEHLVDTVLYFEGNAHANYRMIRSVKNRFGPTNELLILSMHTDGLREVENPSGLFLQEKIVETTGSTIIPIVEGSETLLIEVQALVSSSPFSNPVRKTSGFDPNRFSLLLAVLEKRANVKLYTSDVFLSIAGGLKITQPSADLGAVLSVVSSLYNRYLPKNYTYTGEIGLGGEIRHVSHMEHRIKESIIMGFKGIVMPFGQIKGLPKEFLDQIDIIGVKTIKDAVRLLQ

SEQ ID NO: 12036 - protein, 394 aa, Chlamydia trachomatis D/UW-3/CX
MSKETFQRNKPHINIGTIGHVDHGKTTLTAAITRALSGDGLADFRDYSSIDNTPEEKARGITINASHVEYETANRHYAHVDCPGHADYVKNMITGAAQMDGAILVVSATDGAMPQTKEHILLARQVGVPYIVVFLNKIDMISEEDAELVDLVEMELVELLEEKGYKGCPIIRGSALKALEGDAAYIEKVRELMQAVDDNIPTPEREIDKPFLMPIEDVFSISGRGTVVTGRIERGIVKVSDKVQLVGLRDTKETIVTGVEMFRKELPEGRAGENVGLLLRGIGKNDVERGMVVCLPNSVKPHTQFKCAVYVLQKEEGGRHKPFFTGYRPQFFFRTTDVTGVVTLPEGIEMVMPGDNVEFEVQLISPVALEEGMRFAIREGGRTIGAGTISKIIA

SEQ ID NO: 12037 - protein, 274 aa, Chlamydia trachomatis D/UW-3/CX
MFTDKETHRKPFPTWAHLLHSEPSKQFVFGNWKMNKTLTEAQTFLKSFISSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTTGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 12038 - protein, 485 aa, Chlamydia trachomatis D/UW-3/CX
MIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETALGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDVLSPSLDEIVP

SEQ ID NO: 12039 - protein, 392 aa, Chlamydia trachomatis D/UW-3/CX
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSESSRQGASKKVHITLSFEEAAKGVEKELLVSGYKSCDACSGSGANTAKGVKVCDRCKGSGQVVQSRGFFSMASTCPDCSGEGRVITDPCSVCRGQGRIKDKRSVHVNIPAGVDSGMRLKMEGYGDAGQNGAPAGDLYVFIDVEPHPVFERHGDDLVLELPIGFVDAALGIKKEIPTLLKEGTCRLSIPEGIQSGTVLKVRGQGFPNVHGKSRGDLLVRVSVETPQHLSNEQKDLLRQFAATEKAENFPKKRSFLDKIKGFFSDFAV

SEQ ID NO: 12040 - protein, 394 aa, Chlamydia trachomatis D/UW-3/CX
MKRNPHFVSLTKNYLFADLQKRVAQFRLENPQHTVINLSIGDTTQPLNASVAEAFASSIARLSSPTTCRGYGPDFGLPALRQKLSEDFYRGFVDAKEIFISDGAKVDLFRLLSFFGPNQTVAIQDPSYPAYLDIARLTGAKEIIALPCLQENAFFPEFPEDTHIDILCLCSPNNPTGTVLNKDQLRAIVHYAIEHEILILFDAAYSTFISDPSLPKSIFEIPDARFCAIEINSFSKPLGFAGIRLGWTVIPQELTYADGHFVIQDWERFLSTTFNGASIPAQEAGVAGLSILPQLEAIHYYRENSDLLRKALLATGFEVFGGEHAPYLWVKPTQANISDRDLFDFFLREYHIAITPGIGFGRSGSGFVRFSSLGKREDILAACERLQMAPALQS

SEQ ID NO: 12041 - protein, 350 aa, Chlamydia trachomatis D/UW-3/CX
MSLFSKFKAQWMFLHSRELCSSTSDIGNTCSDPVFQVLCNPVRSEISYKVGDSLGVFPTNPSILVDSVLDALQYGPRSPVVSRHADSVLPLHEFLTSYVDLDKIPKSLRPFFPGDLDDTWSLAEAILVYQPRIPFEEFIRSAMPLLPRFYSIASSPTCSHGKLELLVRCVSFQGKTQLRYGLCSAFLCKDLQEGESFRGFIQPTRHFTLEQKNFGKPLIMIGAGTGIAPYKGFLQHRIYHQDVGSNILFFGERFEKSNFYYRDFLQELIVSGKLQLFTAFSRDSESKLYVQNVIEQQKELIQEVYEQEAFFFVCGKKILGTEVKRALEQILGPKAVRELIAQKRLVSDVY

SEQ ID NO: 12042 - protein, 456 aa, Chlamydia trachomatis D/UW-3/CX
MNLWTKIFQPPCHIKEISDPELVKKQYKYWRMRIFYSMFLGYVFFYFTRKSFTFAMPTLIADLGFDKAQLGIIGSTLYITYGISKFVSGVMSDQSNPRYFMAIGLIITGISNIFFGLSSTIPLFVLFWGINGWFQGWGWPPCARLLTHWYSKSERGTWWSVWSTSHNIGGALIPVLTGVAIDYTGWRGAMFIPGIICIIMGFILIDRLRDTPQSLGLPAIEKFRKEEDAHPHEETTADILEEEAERELSTKEILFTYVLSNKWLWFLSFASFFIYVVRMAVNDWSALYLIETKDYSTVKANLCVSLFEIGGLFGMLLAGWLSDTISKGKRGPMNVVFSLGLLVSILGLWGTRDYFVWWIDGTFLFIIGFFLFGPQMMIGLAAAELSHKKAAGTASGFTGWFAYFGAAFAGYPLGKVAQDWGWHGFFVALLACALIALILFLPTWNASEQSLRKHSH

SEQ ID NO: 12043 - protein, 465 aa, Chlamydia trachomatis D/UW-3/CX
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIAGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 12044 - protein, 424 aa, Chlamydia trachomatis D/UW-3/CX [sequence omitted]

SEQ ID NO: 12045 - protein, 403 aa, Chlamydia trachomatis D/UW-3/CX
MDKLSIRDLSLEGKKVLVRVDFNVPIKDGKILDDVRIHSAMPTIHYLLKQDAAVILVSHVGRPKGGVFEEAYSLAPIVPVLEGYLGHHVPLSPDCIGEVARQAVAQLSPGRVLLLENVRFHKGEEHSDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCASQISHVSTGGGASLEFLEKGSLPGTEILSPAQS

SEQ ID NO: 12046 - protein, 226 aa, Chlamydia trachomatis D/UW-3/CX
MTLLILLRHGQSVWNQKNLFTGWVDIPLSQQGIQEAIAAGESIKHLPIDCIFTSTLVRSLITALLAMTNHSSQKVPYIVHEERPDMSRIHSQKEMEQMIPLFQSSALNERMYGELQGKNKQEVAAQFGEEQVKLWRRSYRIAPPQGESLFDTGQRTLPYFQERIFPLLQQGKNIFISAHGNSLRSLIMDLEKLSEEQVLSLELPTGQPIVYEWTGQKFTKHAPSLG

SEQ ID NO: 12047 - protein, 376 aa, Aquifex aeolicus VF5
MTYLMNNYARLPVKFVRGKGVYLYDEEGKEYLDFVSGIGVNSLGHAYPKLTEALKEQVEKLLHVSNLYENPWQEELAHKLVKHFWTEGKVFFANSGTESVEAAIKLARKYWRDKGKNKWKFISFENSFHGRTYGSLSATGQPKFHKGFEPLVPGFSYAKLNDIDSVYKLLDEETAGIIIEVIQGEGGVNEASEDFLSKLQEICKEKDVLLIIDEVQTGIGRTGEFYAYQHFNLKPDVIALAKGLGGGVPIGAILAREEVAQSFTPGSHGSTFGGNPLACRAGTVVVDEVEKLLPHVREVGNYFKEKLKELGKGKVKGRGLMLGLELERECKDYVLKALEKGLLINCTAGKVLRFLPPLIIQKEHIDRAISVLREIL

SEQ ID NO: 12048 - protein, 288 aa, Aquifex aeolicus VF5
MKVGFIGLGHLGRAIAKRLIEQGVELIVWNRTLSKAHEFAKETGAEVTSSPADLINKVDRVFVIVFDSQASEEVIFGEKGLVKGDIKGKTVIDMTTNHYLYAQKAYEELKKLGAFYLDAPVLGSVIPALKGELTIVVGGDKEKFEENKPLFEKFCRAIYYLGEAGMGSKMKLVNNIVLGGIMEVLAEAIAIGEKAGIDKETLINVLNDGAGKSYILDVKKKKLLEEDFSTHFSVNLIYKDLHYAQDLIKDLGLFSFTTAAVKETYGLARKEGFGNLDFSAVYKLFKED

SEQ ID NO: 12049 - protein, 280 aa, Aquifex aeolicus VF5
MRDIVFIERDPYAPIRHCYTVSKILYQGKSPYQEIQVIESPEFGRMLILDGVVQLDEKYEFLYHEYLAHVPLHAHPNPRNVLIIGGGDGGTLREVLKHDIVERAVLVDIDKEVIEVSKKYLPTLSVGFQDPRAIVVNEDGYKYVQDYENEFDVIIVDSTDPVGFAHVLTTEDFFRHVYKALKEDGIFVAQTESIHYHLEMVSNIQQRLKKVFPIVDLYTSVIPIYAGYWWTFSIASKKYPVRTPAREVKVQTKIYDADMHEYAFLPESFYNKIVNGEYKY

SEQ ID NO: 12050 - protein, 206 aa, Aquifex aeolicus VF5
MILVFLGPPGAGKGTQAKRLAKEKGFVHISTGDILREAVQKGTPLGKKAKEYMERGELVPDDLIIALIEEVFPKHGNVIFDGFPRTVKQAEALDEMLEKKGLKVDHVLLFEVPDEVVIERLSGRRINPETGEVYHVKYNPPPPGVKVIQREDDKPEVIKKRLEVYREQTAPLIEYYKKKGILRIIDASKPVEEVYRQVLEVIGDGN

SEQ ID NO: 12051 - protein, 469 aa, Aquifex aeolicus VF5
MPKYTPEEVLDLIQKEGVQYVDLRFSDPFGQWQHLTIPAYEISKETFEVGRGFDGSSIRGWQSINESDMLAKPDPNTAFIDPFIEPKTLVMICDIYDPVTGERYGRDTRYIAQKAEQYLKQTGIGDTAYFGPEAEFFIFDSVEFGTAANYAFWRVDSEEGWWNREVPSSGYKIPHKRGYFPAPPVDKMMQLRNEMVSIMSDLGIIVELHHHEVATAGQGEIDIRYDSLLNQADKLFLYKYIVRMVAAKHGKYATFMAKVLPNDNGSGMHTHFSIWKNGENLFAGSEYAGLSKTALYAIGGILKHGPAIAAFTNPTVNSYHRLVPGYEAPVRLAYSARNRSAAIRIPMYSQNPKAKRIEVRFPDATSNPYLAFAAILMAAIDGIENEIDPGEPFDKDIYSLPPEELEGIPQLPGSLEEALKALEEDYEFLLKGNVFTEEFIQLWIESKRAEIDELRFIPHPKEFELYWDI

SEQ ID NO: 12052 - protein, 397 aa, Aquifex aeolicus VF5
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 12053 - protein, 453 aa, Aquifex aeolicus VF5
MWELDPKTLEKWDKEYFWHPFTQMKVYREEENLIFERGEGVYLWDIYGRKYIDAISSLWCNVHGHNHPKLNNAVMKQLCKVAHTTTLGSSNVPAILLAKKLVEISPEGLNKVFYSEDGAEAVEIAIKMAYHYWKNKGVKGKNVFITLSEAYHGDTVGAVSVGGIELFHGTYKDLLFKTIKLPSPYLYCKEKYGELCPECTADLLKQLEDILKSREDIVAVIMEAGIQAAAGMLPFPPGFLKGVRELTKKYDTLMIVDEVATGFGRTGTMFYCEQEGVSPDFMCLGKGITGGYLPLAATLTTDEVFNAFLGEFGEAKHFYHGHTYTGNNLACSVALANLEVFEEERTLEKLQPKIKLLKERLQEFWELKHVGDVRQLGFMAGIELVKDKEKGEPFPYGERTGFKVAYKCREKGVFLRPLGDVMVLMMPLVIEEDEMNYVIDTLKWAIKELEKEV

SEQ ID NO: 12054 - protein, 476 aa, Aquifex aeolicus VF5
MIEKKMLIGGEWVDKEEKIEVIYPYTRKPIGRVPKGDEKDVEKAIERAKEGFKEIFSLTAYERYEILMRAAQLLKERAEEFAKTLVLEVGKTIREARTEVQRAIQTLIFSAEEAKRVNGETFPIDAHPNGKGKLGFYIRVPVGIVSAITPFNFPLNLSMHKVAPALAAGNAVILKPSERTPLTPLMLGEILLEAGVPPKALSVIPGYGDVGKAMTTHPDVRVVSFTGSRKVGDIIARQVGIKKLVLELGSNSAIILHKDGNLEKAVEKTVQGGYAIAGQVCISVQRVFVHEDLYDEFIKRLKERVSKLKVGDPMNEDTDLGPMIAPSELERIQEWISEAVQKGAKIEAGGLRCAEDETIFSPTIVSLVPEDSKLFKEEAFAPVVAVNPYKDIEEAIRWVNSSDYGLQVGVFTNDVKLAWKCIKEIEAGGVLINEGPTFRADHMPYGGVKYSGIGREGPKFAIEDYTEIKTVIFDLT

SEQ ID NO: 12055 - protein, 387 aa, Aquifex aeolicus VF5
MFEFSDRLKVLPPYLFAELDRKKQEKIEQGVDVIDLGVGDPDMPTPKPIVEAAKKALENPENHKYPSYVGKYEFRKAVADWYKRRFDVDLDPNTEVITLIGSKEGIAHFPLAFVNPGDIVLCPDPAYPVYRIGAIFAGGTPYTVPLKEENNFLPDLDSIPEDVAKKAKIIWINYPNNPTSAPPTLEFYKKLVDWAKEYNVIIASDNAYSEIYTGQEKPPSILQVPGAKDVAIEFHSLSKTYNMTGWRIGMAVGNKELVAGLGKVKTNVDSGQFGAVQDAGIVALNLPEEEVEKIRDVYRERKKIMTEALEKIGLEIYRSDYTFYLWIKVPEGYTSAEFVGRLIDEAGIVCTPGNGFGEYGEGYFRISLTVPTERLLEAAERIKNLKL

SEQ ID NO: 12056 - protein, 247 aa, Aquifex aeolicus VF5
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 12057 - protein, 276 aa, Aquifex aeolicus VF5
MRFLDRFFKKKKKEEALWTKCPNCKSLLYVPDLESNLKVCPNCDYHFTLSALERIKYTLDEENPELLFEEILPADPLNFKDTKSYKDRIKKAQEETGLSEAIVITEGHIKGKRAILAVMDFNFIGGSMGSVVGERFFRACERAVETKTPLISFAASGGARMQEGILSLMQMAKTTFGVGLLKEANIPYISVLTNPTMGGVSASFAFLGDLILAEPKALIGFAGPRVIEQTIKQKLPEGFQTAEFLLEKGQIDMVVHRKELKDKLAYFLEVMYYAKR

SEQ ID NO: 12058 - protein, 426 aa, Aquifex aeolicus VF5 [sequence omitted]

SEQ ID NO: 12059 - protein, 300 aa, Aquifex aeolicus VF5
MKTLFLIGLGRMGSALAYRLKNRGWEIYGYSRTQTTRERAKKDLGIKVLNSYENLKNFPSPKTVWLMVPHTAVDEVLQNLKPFLNKGDTVIDGGNSYYKDSQRRYRELKEVDVNFLDVGVSGGILGKDTGFSFMIGGDEEVFKKHEKLFKDLAYEEKGYAYLGSSGAGHFAKMVHNGIEYGIMEAIAEGFELLKKSPFDYDLREVARVYSQGSVIRSFLIDLLVKAFEDFGDLEDVEGYVEDSGEGRWCVKESVELGAPIPVIAQSFYERFSSREKDLFKNKVLAVLRYEFGRHRVKKKD

SEQ ID NO: 12060 - protein, 499 aa, Aquifex aeolicus VF5
MEQGYRTISRKTLRPLQKDIRKITFLCKAECSRKRIIQYSIMIKFGTDGWRARIAEEFNFDNVRRVAKAHAEVLKEKGVKRVIVGYDWRFRSEDFAKAVYDVFRSEGLEAKLVGSACTTPMVSFAVKYLGYENGVMITASHNPPAYNGYKIKESFGGSATPEFVKNVEEKVKDIESVEIKEFEPEYQEVRKKYVEKIREFFDMDLFKEKKTLVVHDSMHGTSSGLLDFVLRDTKVSVINIRKDRDPLFGGHPPEPIEKYMEITKEKVRALGAELGIANDGDGDRIALVDDKGNYVNTQLIYAMLLLHLLENKGKRGKVVKTVSTTYLADRICKEFGVPLIEVGVGFKNINEIILKEGGVIFGGEESGGYGIPEYLPERDGIFSALNILELLYLKDKKVSEVVAEIFERFGEAYYKRVDLRVKEKIKGRIKELKENPPERIGEFKVREVKTIDGVKFVFEDDSWLLMRPSGTEPLIRVYAETPTKEEVEKIIQKGLELLK

SEQ ID NO: 12061 - protein, 178 aa, Aquifex aeolicus VF5
MKEIRGKKLKLLLKEEDIKRRVKELAKEIESSYSWEEPIVVVGLLKGAFIFLADLVRAFDRFVFVEFMQVSSYGKGMKSSGTIKIVKDLDMDIEGKEVLLVDDILDTGLTMKEIHDYLLMKKPKVLKTCVFLDKKERRKVDFNADFVGFEVPDKFLVGYGLDWGEYGRNLPEVYMVED

SEQ ID NO: 12062 - protein, 444 aa, Aquifex aeolicus VF5
MGKNKTAYVCQECGYKSVKWLGKCPSCGEWNTLVEEFEPQSFSLVKKEPSLVLPVTDWEKEEHERETTGFESLDNALGGGLVKGQVILIAGEPGIGKSTLLLQISDRVANGKKVLYVSGEESGTQIALRAKRLGINNENLLVYPEVNLEKILQTLEKEKPSLLVLDSVQTIFSERLESSAGSVSQVREVTYRITEFCKEKNVPAFIVGQITKEGSIAGPKVLEHIVDTVLQFEGERFNFYRIVKVIKNRFGSTGEIAVFKMTDKGLEEVPEPSAFFISEKANAPGSVVFPHTEGSKPVLLEVQALVIPALYTTPQRRTQGFDPNRLALILAVLEKEAKIFTRDQDVFVNVAGGMSVKEPAADLAVAMAVVSSKKEKEVPKDFVIFGEVGLSGEIRAVHFGDLRLKEAKRFGFKKALIPKSLEIEIDGMEIYPVSHIQEAIEVLF

SEQ ID NO: 12063 - protein, 453 aa, Aquifex aeolicus VF5
MKILILSGGKGTRLWPLSRENFPKQFIRLFSKHSLFQETVKRAKKLAKDEDIVVITGEKYEWIIRSELEEIDANEVRVVVEPEGRNTAPAIALGVKYLIHSETPPSETVLVLPSDHLIKDTEKFVEAVKKGEKYAKEGYIVLFGEKPTYPETGYGYIRLNGKLEEGVYEIEKFEEKPDYEKAKEYVSDGKHFWNCGIFLFTLDRIVKDYTQLMPEIPFHEKWEDFIKDFKNFEEISFDYAILERTKKLAVVKMDAGWSDVGSWKAVYDNLPKDEKRNVLIGDVKAMDTECSLLLSQGKNLIACIGLEDFVVVGTEDATLIVKRDYSQKVKEIVKELEEENDERAIEHVTSFTPFGSITKLDRGERYKIRKVVVKKDKEIPLRMHHHRTVHFVVLKGTAKVKVGDKEEFVHENESFFVPKSTPYKIINVGKIPLEMIEVQSGEYLGEDDVETLE

SEQ ID NO: 12064 - protein, 334 aa, Aquifex aeolicus VF5
MNVLFTSVPQEDVPFYQEALKDLSLKIYTTDVSKVPENELKKAELISVFVYDKLTEELLSKMPRLKLIHTRSVGFDHIDLDYCKKKGILVTHIPAYSPESVAEHTFAMILTLVKRLKRIEDRVKKLNFSQDSEILARELNRLTLGVIGTGRIGSRVAMYGLAFGMKVLCYDVVKREDLKEKGCVYTSLDELLKESDVISLHVPYTKETHHMINEERISLMKDGVYLINTARGKVVDTDALYRAYQRGKFSGLGLDVFEDEEILILKKYTEGKATDKNLKILELACKDNVIITPHIAYYTDKSLERIREETVKVVKAFVKGDLEQIKGNFVVGPS

SEQ ID NO: 12065 - protein, 465 aa, Aquifex aeolicus VF5
MEFDLIIVGAGSGGYEAGLYAFRRGMKVAFVELSPETVGGNCLNRGCIPSKYMRHGAYLLDKFQKMEQYGIISKGYDIEYKKLKEGRDNVVVTIRENFKKFAQQLRIPIYYGKGVLKDPNTVFVEGPEETLKAKYILVATGSSPTSVGNLVPDGKYVIDTDQIWEIDYVPKKVLIVGGGAVGVEFAYIFRKYGSEVVLVEIKDRLLPTPDIPEDSGRYLARKLRELGVDIRTRTSVESWEKTQNGVKAKLTDGSEVVADFILLGVGRKPNTKGIGLEELGIEMDERGFVKTNEYAQTNIPNIYACGDITSPLMLAHKSMYEGKIAVSHILGERDWKKNERIIPKIIYSALEVASVGLTEEQAEDEDIEVRVGVASFVSNPKAMDDGENEGFVRIVADDETGEILGCHIVGPHAGELIHQVVHMIKDGKTVEFASKTMYSHPSLSENIGIASSEVYYGPISWVKRR

SEQ ID NO: 12066 - protein, 424 aa, Aquifex aeolicus VF5
MKNEKLYREALQVMPGGVNSPVRAFKAVGGKPIFLVKGRGPRVWDAEGNEYIDFLASWGAIILGHAPKKVVKAVQEEAEKGLSFGLTNPHEVTLAKLVVEMVPSVEKVRFVNSGTEATMSAVRLARGVTGRKYIVKFEGCYHGHYDSLLVSAGSGVATFGIPGTPGIPEEIAKLTIVLPYNDVQALEEAFKEYGSEIAGVIVEPIAGNMGVVPPKKEFLIRLRELTKEYGSLLMFDEVITGFRLSKGGAQELFGIEPDITCLGKILGGGLPVGAYGGRREIMERVAPEGEVYQAGTLAGNPLAMVSGSETLKDLRDKEPYKELEEKMEKLARGVKDILTEKGIQHTINKVGSMMTVFFTDKKVVDFQTAKTSDTELFAKFFRALLNKGVLIPPSQFEAWFLTTAHEEEVIDEALERIRDAVKEL

SEQ ID NO: 12067 - protein, 474 aa, Aquifex aeolicus VF5
MKVVIVGNGPAAASAVEAFRKVDRDSEIIILSDEEFPTYAPNCMENVIRDDISKEALFYKGGEKFYEKYRVDFRPKTEVVGIDNKRKVVITKKGEEISYDKCLLAAGAYSFIPPIDGVDLERVTTAKNLYDAYKIRSWILSGKITKAVIIGAGPIGIEDAETLRHMGIDVTVIEVFDRILPRMLDRQMGKLYQKPLEEEGIEFLLEHQVVAIHGKNGEVEAVEVKKRGTDKTFFIKTDMVIISTGVRPRTYLVEGTDIEIHMDKKLNKPIGGILVNEYQQTSDPDVYAAGDIASGVDMWGNHRWIALFPPAQQAGYVAGFNMAGLKVRNNGLVDYNAVKTRSVTAGSGGLFEDADESFFLEYKEYLVKVFLKDGKVRGYQFVGVPKYPKLNPRNPLIRVLNKINTWEEKVLLDKGLGLEASGALFHFFVKLNREFKEVHRRLVEEMFVRAMANPSREIPLFTVQEGEVLKTVGK

SEQ ID NO: 12068 - protein, 362 aa, Aquifex aeolicus VF5
MEELKELRKEIDRIDEEILRLLNERAKLAKRIGEIKSKANLPIHVPEREREIFEKILRLNKEVYGGVFPQEALVHIYREIISACLSLEKKIKVAYLGPKATFTHQAALEFFGFSAHYTPCSTIRDVFVEVETKRADYGVVPVENTIEGVVNYTLDMFLESDVKIAGEIVIPITLHLLSASDSIENVEKVYSHKMALAQCRSWLEKNLPSVQVIEVESTAKACEIALEDERAGAVASEVAAYTYHLNILARNIQDSGDNFTRFLVIAKRDLKPTGSDKTSILFGVKDEPGALYKALEVFYKHGINLTKIESRPSKKKAWDYVFFVDLEGHKEEERVEKALKELKEKTQFLKVLGSYPKALLQE

SEQ ID NO: 12069 - protein, 222 aa, Aquifex aeolicus VF5
MKLLAPSILAGDWWCIGEQIQATIRGGADILHYDVMDGHFVPNITAGYEILSHIRKRASLPIDAHLMIENPDKYIPKFVEAGANWISVHIENNYHIHRTLQLIKELGAKAGVVVNPGTSLSAIEEALYYADYVLLMSVNPGFSGQKFIERSIERLRILKEMRDRINPSCLIEIDGGIKENNIAEVVRAGADVVVVGSGIFGAKDIEAQTRKLKSLMLSAVSV

SEQ ID NO: 12070 - protein, 1015 aa, Aquifex aeolicus VF5
  misc_feature (199)..(199): Xaa can be any naturally occurring amino acid
MNYMDISRRGFLKLSVGSVGAGILGGLGFDLTPAYARVRDLKITKAKVTKSICPYCSVSCGILAYSLSDGAMNVKERIIHVEGNPDDPINRGTLCPKGATLRDFVNAPDRLTKPLYRPAGSTEWKEISWDEAIEKFARWVKDTRDRTFIHKDKAGRVVNRCDSIVWAVGSPLGNEEGWLMVKIGIALGLSARETQATIXHAPTVASLAPTFGRGAMTNNWVDISNSDLVFVMGGNPAENHPCGFKWAIKAREKRGAKIICIDPRFNRTAAVADIFVQIRPGTDIAFLGGLINYVLQNEKYQKEYVRLHTTGPFIVREDFGFKDGLFTGYDPKTRSYDTTTWDYEFDPATGYPKMDPEMKHPRCVLNILKEHYSRYTPEVVSQICGCSKEDFLRVAEEVAKCGAPNKFMTILYALGWTHHSYGTQLIRTACMLQLLLGNIGCPGGGINALRGHSNVQGMTDLAGQNKNLPTYIKPPKPEEQTLAQHLKNRTPRKLHPTSLNYWANYPKFFISFLKCMWGDAATPENDFAYDYLYKPEGGYNSWDKFIDDMYKGKIEGVVTAALNFLNNTPNAKKTVRALKNLKWMVVMDPFMIETAQFWKAEGLDPKEVKTEILVLPTAVFLEKEGSFTNSARWVKWKYKATDPPGDAKDEFWIFGRFFMKLKEFYEKEGGAFPEPILNLVWPYKNPYYPTAEEILTEINGYYTRDVDGHKKGERVRLFTDLRDDGSTACGGWLYCGVFPPEGNLAKRTDLSDPLGLGTYPNYAWNWPANRRVLYNRASCDEKGRPWDPERPLLRWDPERDMWVGDIPDYPATAPPEKGIGAFIMLPEGKGRLFAAKSYVTFKDGPLPEHYEPYESPVTNILHPNVPHNPVAKVYKSDLDLLGTPDKFPHVATTYRLTEHYHFWTKHLYGPSLLAPVMFIEIPEELAKEKGIQNGDLVRVSTARASIEAIALVTKRIKPLKVAGKTVYTIGIPIHWGFEGLVKGAITNFITPNVWDPNSRTPEFKGFLANIEKVKT

SEQ ID NO: 12071 - protein, 426 aa, Aquifex aeolicus VF5
MKYLGLCTDLYELTMAQSYLYEGKTGTAVFSLFVRKLPEKRNFLISAGLETLVERIKNFKFGDEEIKYLKSLGIFKDDFLDYLKDFEFSGNVYAIPEGRIVFQNEPLVQVEAPIPEAQLLETLVINTIQFETMIASKAVRSYLVAKGKKLVDFGFRRAHGLEAGILAARASYIAGFDGTSNVEAGREFGIPVVGTMAHSYVMIFDKEEDAFRAFAKLYPKNAIFLIDTYDTIEAAKKVVDLAKEGVPVVGVRIDSGDIVKLSKEVRKILDENGLKNVRIIVSGGVDEYKIKEWFDRGAPIDAFGVGTKFITSADAPYFDIAYKLVEYEGKPKYKLSPGKKTFPYKRQVYRYYENGKMKYDETAKWESKREGEPLVELVMKNGKLIKELPSLKEIREVVMSELEKLPENYKDITKHYEYEVKILDWE

SEQ ID NO: 12072 - protein, 343 aa, Aquifex aeolicus VF5
MKAVILTGFGGIENLKYVEDFPKPEPKEDEVLIRVKAVALNHLDIWVRMGALPVKPELPHILGSDVSGVVEKVGSLVKNVKEGEEVIIAPGLSCGVCWDCQSGRDNHCKDYDILGLKNKGGYAEYVAVPARNVIKKPKNLSFEEAASYPLTFLTVWNALVDKAQIKPYSRVFIWAGSSGVGVAGIQLAKAFNAFVITTAGNEEKAKKCKELGADLVFNHYKDDVVKKVREVFKEGVDVVVDHIGEATFWKSVQMLRKGGKLVFFGTTTGSKGEIDIRYVFVREIQLLGVYMGSRANLFKITELFERGVFKPVVDKVFPLKEVPQAHKYLEESKHFGKVVLKVE

SEQ ID NO: 12073 - protein, 499 aa, Aquifex aeolicus VF5
MKILKAHEMSSIDNKTIEEIGIPSLVLMENASKGVFENIRKYFPDAKNILVVAGKGNNGGDGLALARHLYLNGFSVDIFLAFGEVKGDAKTQLEILKKIGIEPLKKKPDFKEYDLIVDAIFGTGFQPPVKGEVANLIKEINNSSVPIVSIDIPSGLSADTGESFEPSVKADLTVTFQFPKICHYLYPAAKKCGKVEVVDISIPEFLAKDVKRDLLRKSDLKPYKREPDTYKTKEGSVLLVGGSVGKTGAVIMSAKAASRAGAGLVTVGIPRELNPIFESLLIEEMSLPLSGTSRLSVFCVEEILELKDRFHALGIGMGMDRYEEGQDIVISLLEKWEKPILIDADGINNLADYGDYTPLKDREIPAVLTPHIGEFSRLTGYDTKTITYNQIDIAQEFSEKNRCYLVLKGARTVISTPDGRAYLFADGTPALAKGGTGDVLAGILTALIAKMDTEEALKLGVYLHGLAGKVAEKKLHTESVKATDVTESLPEAFREIYVN

SEQ ID NO: 12074 - protein, 247 aa, Aquifex aeolicus VF5
MIVEFEEVYSGYGNTVVHKGISFKVESSQIVAIVGGSGAGKTTLLRLILGLLKPLKGEVRLFGKSIKNLSEEELQKLRDRMGVVFQFSALFGSMTVLENVMYPVIKKRKLDRSIVEMNACFKLSVCGLKPEDFYKYPQELSGGMKKKTALARALSLDPELLILDEPTSGLDPISAEEFDNLIKTVRDTFGTTVIMVTHDLPSLRICDKVLALREGKIVFDGKPQELFESEDPWIKELVKTSRGKCIL

SEQ ID NO: 12075 - protein, 262 aa, Aquifex aeolicus VF5
MGRISDKFTELKEKREKALVSYLMVGYPDYETSLKAFKEVLKNGTDILEIGFPFSDPVADGPTIQVAHEVALKNGIRFEDVLELSETLRKEFPDIPFLLMTYYNPIFRIGLEKFCRLSREKGIDGFIVPDLPPEEAEELKAVMKKYVLSFVPLGAPTSTRKRIKLICEAADEMTYFVSVTGTTGAREKLPYERIKKKVEEYRELCDKPVVVGFGVSKKEHAREIGSFADGVVVGSALVKLAGQKKIEDLGNLVKELKEGLRE

SEQ ID NO: 12076 - protein, 327 aa, Aquifex aeolicus VF5
MSLKSCLMWVLGEHDEPYRKARETILKLVGNTPLVRVKKCLPEDIPEDVEIWAKLESFNPGGSVKDRPALSMFLDALKRGLIKEGKVVIDATSGNTGIALAMVGAALGVPVELAMPANVSEERKKIIKAFGAKLYLTDPLEGTDGAILFVRELVQKYPEKYVYLDQYNNPANWKAHFYSTGIEIWNQTKGRITHFVAGIGTGGTIMGTGRRLKIYNPNIQVIGVQPAYPFHGIEGLKHIESSIKPGIFDETFLDRTIFVETEDAYYWARELAKKDAIFVGQSSGAALWACIQLARELAKKGEKGVIVTVFPDGGEKYLTTALFSDKD

SEQ ID NO: 12077 - protein, 506 aa, Aquifex aeolicus VF5
MRAIISVYRKEGIDKLAKALQELGYEIVSTGGTAKYLREKGISVKEVSEITGFPEILEGRVKTLHPVVHGGILFRDWVEKDKEEIEKHGIKPIDVVVVNLYPFEEKLKEGLTDKDLMEFIDIGGPTLIRAAAKNFFRVVILVDPEDYDWVIEKLKKGNLTLQDRAYLAWKAFSHTAYYDGVISQAFKKLYSIDTFGKEEALPLKRMQKLRYGENPHQRGFLYENPLEDIGITKAQVLQGKEMSFNNYLDADSAVRLVAEFPNQTVCAIIKHNNPCGVALGSSVKEAFLRAKEADPVSAFGGIVAFNDKVDGETAKELTSMFLEVVIAPDYDEEALRELSRKKNLRVIRFFGFQHAFDVKKVSGGYLLQDEDTVLYEKLQVVTKREPTAEEMEDLLFAWKVVKHTKSNAVVIAKNGQTLGIGSGNVSRVDSLKCAINKAKEFGFDLKGAVVASEAFFPFRDSIDIMAKEGITAVIQPGGSIRDQEVIDACNEHGIAMIFTGLRHFKH

SEQ ID NO: 12078 - protein, 205 aa, Aquifex aeolicus VF5
MLKLKFNEEGLIPVIAQDYRTGEVRMLAYANEEAIKKTLETGYAHYYSRSRKKIWKKGETSGELQKVIEVRVDCDEDALIYVIEQEKDRACHTGERNCFFRDIEGNKVEKPLPFEVLPRLQDVIREKIERKEENSYTAKLVSQGKERVFQKFGEEAVETLIALMKGEKEEVIYESADMLYTFLVSLSVSGIDIKEVMEELIRRFK

SEQ ID NO: 12079 - protein, 490 aa, Aquifex aeolicus VF5
MVEVEKKIKEGLTFDDVLLVPQYSEVLPHEVDVSTYLTKRIKLNIPIVSAAMDTVTEARLAIALAREGGIGIIHRNLPIKKQAEEVEKVKKSESGMIINPVTVKPDTRVKEALDIMAKYKISGVPVVDEERKLIGILTNRDLRFIKPEDYSKPVSEFMTKENLITAPEGITLDEAEEIFRKYKIEKLPIVDKEGKIKGLITIKDIVKRKKYPNACKDELGRLRVGAAVGTGEETLDRVAALVEAGVDVIVVDTAHGHSKRVLETVEKIKANFPEVDVIAGNVATAEGTKALIEAGADAVKVGVGPGSICTTRIVAGVGVPQLTAIMEAASAAREYDIPIIADGGIRYSGDIVKALAAGASAVMLGNLLAGTEEAPGETIYYQGRAYKVYRGMGSLGAMSSRLSSDRYGQEKMEKFVPEGIEGRVPYKGKLADVVYQLVGGLRSGMGYVGARNIKELQEKAKFVRITWAGYRESHVHDVQITREAPNYWVD

SEQ ID NO: 12080 - protein, 476 aa, Aquifex aeolicus VF5
MAKKIRYLDRNKEPTLPPEERVKTFREFELGYSVNLALDEAQRCLFCKDAEQRCIKGCPVHVDIPGFIKKITEGDLVGAYKVITQSDIFPSICGRVCPQERQCEGSCILYYDTVRNRKNKGLPVAIGALEKFVGDFIRISGIEIEEEKEPPTGFRVAVIGAGPAGLSCAHELAKKGHEVHVYEALPKPGGVMYYGIPNARLDKSIIEWEVKRLEKLGIKFFYGYLIGKNITLQELREKYDAVFIAVGAGRGKLGLPGDHLKGVYSAIDFLMRVNLYKANEFPKKGVPVELGKRTVIIGGGFTAVDCAITANRLGVETHVVYRRTRETSSARQEEWDHLMEEGVKIHWLTQPVEVIGNEKGEVVGLKCIKMELGEPDESGRPRPVPVPNSEHIIECDSVIFAIGQRANPIAYEGSGIKTTKWGTIEVNERYETNLEGVFAGGDVINGGDRVVVALAHGKEAAKYIHEYLMSNKEVRK

SEQ ID NO: 12081 - protein, 414 aa, Aquifex aeolicus VF5
MIEDPMDWAFPRIKRLPQYVFSLVNELKYKLRREGEDVVDLGMGNPNMPPAKHIIDKLCEVAQKPNVHGYSASRGIPRLRKAICNFYEERYGVKLDPEREAILTIGAKEGYSHLMLAMISPGDTVIVPNPTYPIHYYAPIIAGGEVHSIPLNFSDDQDHQEEFLRRLYEIVKTAMPKPKAVVISFPHNPTTITVEKDFFKEIVKFAKEHGLWIIHDFAYADIAFDGYKPPSILEIEGAKDVAVELYSMSKGFSMAGWRVAFVVGNEILIKNLAHLKSYLDYGIFTPIQVASIIALESPYEIVEKTAKVYQKRRDVLVEGLNRLGWKVKKPKATMFVWAKIPEWINMNSLDFSLFLLKEAKVAVSPGVGFGQYGEGYVRFALVENEHRIRQAIRGIRKAFRKLQKERKLEPERSA

SEQ ID NO: 12082 - protein, 136 aa, Aquifex aeolicus VF5
MCGDLASYDEEGYIMILGRADDVINVAGHRIGTMEVESALVSHPDVAEAAVIGKPHEVKGESIKAFVVLKKGVEPSEKLVEELKLHVRNVLGPIAVPDEIEFREKLPKTRSGKIMRRILKAEELGLDVGDVSTLEE

SEQ ID NO: 12083 - protein, 297 aa, Aquifex aeolicus VF5
MKDFSFLLILVSLSLLGILFPEFFANLKPLILPLLIVIMLSMGLTLTPEDFKEIARKPFIVFYGALLQYTVMPLSGYLLSKLFKLPPELLVGVVLVGSAPGGTASNLITYLSRGDLSYSISMTTTSTLLSPLFTPLWTYVLAGKYVEVPFLSMFETTLKIVIVPVLLGMVLRYFLRYQINKVEKFLPFLAVFSISLIIAVIFALNSKLLKELSFLVLSVVLIHNVLGFLLGYLFGLLAGLDKRKVKALSIEVGMQNSGLSTVLALKYFSKVSALPSAIFSLSQNLIGVVLSLFFRRL

SEQ ID NO: 12084 - protein, 253 aa, Aquifex aeolicus VF5
MDEVVRLEHIYKEIEGRVILKDVNFSVYKGEIFSIIGGSGSGKTSITKLIVGLWKPTKGKVLVFRKNVPELSGLELDELRKNIGYVFQEGALFDSYRVWENVVFYYLEHGKHNKEELRKMALENLKLVNVDESVLDLYPSELFGGMRKRVAIARAIATRPQLIIYDEPTSGLDPITSRVIDKLILELRNKTGTTSLVVTHDMISAFTISDRVMVIKNGEIIAIGKPDEVIDYPHPYIQEFVGAIKSCLKHAKV

SEQ ID NO: 12085 - protein, 303 aa, Mycobacterium tuberculosis H37Rv
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTEVVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 12086 - protein, 330 aa, Mycobacterium tuberculosis H37Rv
MGDLSIQNLVVEYYSGGYALRPINGLNLDVAAGSLVMLLGPSGCGKTTLLSCLGGILRPKSGAIKFDEVDITTLQGAELANYRRNKVGIVFQAFNLVPSLTAVENVMVPLRSAGMSRRASRRRAEELLARVNLAERMNHRPGDLSGGQQQRVAVARAIALDPPLILADEPTAHLDFIQVEEVLRLIRELADGERVVVVATHDSRMLPMADRVVELTPDFAETNRPPETVHLQAGEVLFEQSTMGDLIYVVSEGEFEIVHELADGGEELVKVAGPGDYFGEIGVLFHLPRSATVRARSDATAVGYTVQAFRERLGVGGLRDLIEHRALAND

SEQ ID NO: 12087 - protein, 441 aa, Mycobacterium tuberculosis H37Rv
MSEVVTAAPAPPVVRLPPAVRGPKLFQGLAFVVSRRRLLGRFVRRYGKAFTANILMYGRVVVVADPQLARQVFTSSPEELGNIQPNLSRMFGSGSVFALDGDDHRRRRRLLAPPFHGKSMKNYETIIEEETLRETANWPQGQAFATLPSMMHITLNAILRAIFGAGGSELDELRRLIPPWVTLGSRLAALPKPKRDYGRLSPWGRLAEWRRQYDTVIDKLIEAERADPNFADRTDVLALMLRSTYDDGSIMSRKDIGDELLTLLAAGHETTAATLGWAFERLSRHPDVLAALVEEVDNGGHELRQAAILEVQRARTVIDFAARRVNPPVYQLGEWVIPRGYSIIINIAQIHGDPDVFPQPDRFDPQRYIGSKPSPFAWIPFGGGTRRCVGAAFANMEMDVVLRTVLRHFTLETTTAAGERSHGRGVAFTPKDGGRVVMRRR

SEQ ID NO: 12088 - protein, 506 aa, Mycobacterium tuberculosis H37Rv
MSDRVKAVAPPDGRTMMTTESVARKTQKSETEAPREPAPVSDEKQTDVAKTVARLRKTFASGRTRSVEWRKQQLRALQKLMDENEDAIAAALAEDLDRNPFEAYLADIATTSAEAKYAAKRVRRWMRRRYLLLEVPQLPGRGWVEYEPYGTVLIIGAWNYPFYLTLGPAVGAIAAGNAVVLKPSEIAAASAHLMTELVYRYLDTEAIAVVQGDGAVSQELIAQGFDRVMFTGGTEIGRKVYEGAAPHLTPVTLELGGKSPVIVAADADVDVAAKRIAWIKLLNAGQTCVAPDYVLADATVRDELVSKITAALTKFRSGAPQGMRIVNQRQFDRLSGYLAAAKTDAAADGGGVVVGGDCDASNLRIQPTVVVDPDPDGPLMSNEIFGPILPVVTVKSLDDAIRFVNSRPKPLSAYLFTKSRAVRERVIREVPAGGMMVNHLAFQVSTAKLPFGGVGASGMGAYHGRWGFEEFSHRKSVLTKPTRPDLSSFIYPPYTERAIKVARRLF

SEQ ID NO: 12089 - protein, 302 aa, Mycobacterium tuberculosis H37Rv
MSGNEVHPDLRRIAVVTPRQLVGPRTLPVMRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRPSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 12090 - protein, 487 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVA

SEQ ID NO: 12091 - protein, 449 aa, Mycobacterium tuberculosis H37Rv
MASTLTTGLPPGPRLPRYLQSVLYLRFREWFLPAMHRKYGDVFSLRVPPYADNLVVYTRPEHIKEIFAADPRSLHAGEGNHILGFVMGEHSVLMTDEAEHARMRSLLMPAFTRAALRGYRDMIASVAREHITRWRPHATINSLDHMNALTLDIILRVVFGVTDPKVKAELTSRLQQIINIHPAILAGVPYPSLKRMNPWKRFFHNQTKIDEILYREIASRRIDSDLTARTDVLSRLLQTKDTPTKPLTDAELRDQLITLLLAGHETTAAALSWTLWELAHAPEIQSQVVWAAVGGDDGFLEAVLKEGMRRHTVIASTARKVTAPAEIGGWRLPAGTVVNTSILLAHASEVSHPKPTEFRPSRFLDGSVAPNTWLPFGGGVRRCLGFGFALTEGAVILQEIFRRFTITAAGPSKGETPLVRNITTVPKHGAHLRLIPQRRLGGLGDSDPP

SEQ ID NO: 12092 - protein, 395 aa, Mycobacterium tuberculosis H37Rv
MSTPTPPALDRDDPLGLDASLSSDEIAVRDTVRRFCAEHVTPHVAAWFEDGDLPVARDLAKQFGELGLLGMQLHGHGCGGASAVHYGLACRELEAADSGIRSLVSVQGSLAMFAIASFGSDEQKRQWLPGMATGDLLGCFGLTEPDVGSDPAAMKTRARRDGPDWVITGGKMWITNGSVADVAIVWAATDDGIRGFIVPTDTPGFTANTIGHKLSLRASITSELVLDNVRLPADAMLPGATGLRAPLACLSEARYGIVWGAMGAARSAWQCALDYARQRTQFGRPIAGFQLTQAKLVDMAVELHKGQLLSLHLGRLKDRVGLRPDQVSFGKLNNTREALKICRTARTILGGNGISLEYPVIRHMVNLESVLTYEGTPEMHQLVLGQAFTGLAAFR

SEQ ID NO: 12093 - protein, 311 aa, Mycobacterium tuberculosis H37Rv
MTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 12094 - protein, 507 aa, Mycobacterium tuberculosis H37Rv
MTVFSRPGSAGALMSYESRYQNFIGGQWVAPVHGRYFENPTPVTGQPFCEVPRSDAADIDKALDAAHAAAPGWGKTAPAERAAILNMIADRIDKNAAALAVAEVWDNGKPVREALAADIPLAVDHFRYFAAAIRAQEGALSQIDEDTVAYHFHEPLGVVGQIIPWNFPILMAAWKLAPALAAGNTAVLKPAEQTPASVLYLMSLIGDLLPPGVVNVVNGFGAEAGKPLASSDRIAKVAFTGETTTGRLIMQYASHNLIPVTLELGGKSPNIFFADVLAAHDDFCDKALEGFTMFALNQGEVCTCPSRSLIQADIYDEFLELAAIRTKAVRQGDPLDTETMLGSQASNDQLEKVLSYIEIGKQEGAVIIAGGERAELGGDLSGGYYMQPTIFTGTNNMRIFKEEIFGPVVAVTSFTDYDDAIGIANDTLYGLGAGVWSRDGNTAYRAGRDIQAGRVWVNCYHLYPAHAAFGGYKQSGIGREGHQMMLQHYQHTKNLLVSYSDKALGFF

SEQ ID NO: 12095 - protein, 464 aa, Mycobacterium tuberculosis H37Rv
MTHYDVVVLGAGPGGYVAAIRAAQLGLSTAIVEPKYWGGVCLNVGCIPSKALLRNAELVHIFTKDAKAFGISGEVTFDYGIAYDRSRKVAEGRVAGVHFLMKKNKITEIHGYGTFADANTLLVDLNDGGTESVTFDNAIIATGSSTRLVPGTSLSANVVTYEEQILSRELPKSIIIAGAGAIGMEFGYVLKNYGVDVTIVEFLPRALPNEDADVSKEIEKQFKKLGVTILTATKVESIADGGSQVTVTVTKDGVAQELKAEKVLQAIGFAPNVEGYGLDKAGVALTDRKAIGVDDYMRTNVGHIYAIGDVNGLLQLAHVAEAQGVVAAETIAGAETLTLGDHRMLPRATFCQPNVASFGLTEQQARNEGYDVVVAKFPFTANAKAHGVGDPSGFVKLVADAKHGELLGGHLVGHDVAELLPELTLAQRWDLTASELARNVHTHPTMSEALQECFHGLVGHMINF

SEQ ID NO: 12096 - protein, 462 aa, Mycobacterium tuberculosis H37Rv
MGSTEQATSRVRGAARTSAQLFEAACSVIPGGVNSPVRAFTAVGGTPRFITEAHGCWLIDADGNRYVDLVCSWGPMILGHAHPAVVEAVAKAAARGLSFGAPTPAETQLAGEIIGRVAPVERIRLVNSGTEATMSAVRLARGFTGRAKIVKFSGCYHGHVDALLADAGSGVATLGLCDDPQRPASPRSQSSRGLPSSPGVTGAAAADTIVLPYNDIDAVQQTFARFGEQIAAVITEASPGNMGVVPPGPGFNAALRAITAEHGALLILDEVMTGFRVSRSGWYGIDPVPADLFAFGKVMSGGMPAAAFGGRAEVMQRLAPLGPVYQAGTLSGNPVAVAAGLATLRAADDAVYTALDANADRLAGLLSEALTDAVVPHQISRAGNMLSVFFGETPVTDFASARASQTWRYPAFFHAMLDAGVYPPCSAFEAWFVSAALDDAAFGRIANALPAAARAAAQERPA

SEQ ID NO: 12097 - protein, 472 aa, Mycobacterium tuberculosis H37Rv
MSGTSSMGLPPGPRLSGSVQAVLMLRHGLRFLTACQRRYGSVFTLHVAGFGHMVYLSDPAAIKTVFAGNPSVFHAGEANSMLAGLLGDSSLLLIDDDVHRDRRRLMSPPFHRDAVARQAGPIAEIAAANIAGWPMAKAFAVAPKMSEITLEVILRTVIGASDPVRLAALRKVMPRLLNVGPWATLALANPSLLNNRLWSRLRRRIEEADALLYAEIADRRADPDLAARTDTLAMLVRAADEDGRTMTERELRDQLITLLVAGHDTTATGLSWALERLTRHPVTLAKAVQAADASAAGDPAGDEYLDAVAKETLRIRPVVYDVGRVLTEAVEVAGYRLPAGVMVVPAIGLVHASAQLYPDPERFDPDRMVGATLSPTTWLPFGGGNRRCLGATFAMVEMRVVLREILRRVELSTTTTSGERPKLKHVIMVPHRGARIRVRATRDVSATSQATAQGAGCPAARGGGPSRAVGSQ

SEQ ID NO: 12098 - protein, 463 aa, Mycobacterium tuberculosis H37Rv
MAIRQHVGALFTDLYEVTMAQAYWAERMSGTAVFEIFFRKLPPGRSYIMAAGLADVVEFLEAFRFDEQDLRYLRGLGQFSDEFLRWLAGVRFTGDVWAAPEGTVIFPNEPAVQLIAPIIEAQLVETFVLNQIHLQSVLASKAARVVAAARGRPVVDFGARRAHGTDAACKVARTSYLAGAAGTSNLLAARQYGIPTFGTMAHSFVQAFDSEVAAFEAFARLYPATMLLVDTYDTLRGVDHVIELAKRLGNRFDVRAVRLDSGDLDELSKATRARLDTAGLEQVEIFASSGLDENRIAALLAARCPIDGFGVGTQLVVAQDAPALDMAYKLVAYDGSGRTKFSSGKVIYPGRKQVFRKLEHGVFCGDTLGEHGENLPGDPLLVPIMTNGRRIRQHAPTLDGARDWARQQIDALPPELRSLEDTGYSYPVAVSDRIVGELARLRHADTAEAHPGSNVVGAKAKRP

SEQ ID NO: 12099 - protein, 359 aa, Mycobacterium tuberculosis H37Rv
MRYSDSYHTTGRWQPRASTEGFPMGVSIEVNGLTKSFGSSRIWEDVTLTIPAGEVSVLLGPSGTGKSVFLKSLIGLLRPERGSIIIDGTDIIECSAKELYEIRTLFGVLFQDGALFGSMNLYDNTAFPLREHTKKKESEIRDIVMEKLALVGLGGDEKKFPGEISGGMRKRAGLARALVLDPQIILCDEPDSGLDPVRTAYLSQLIMDINAQIDATILIVTHNINIARTVPDNMGMLFRKHLVMFGPREVLLTSDEPVVRQFLNGRRIGPIGMSEEKDEATMAEEQALLDAGHHAGGVEEIEGVPPQISATPGMPERKAVARRQARVREMLHTLPKKAQAAILDDLEGTHKYAVHEIGQ

SEQ ID NO: 12100 - protein, 406 aa, Mycobacterium tuberculosis H37Rv
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADGTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 12101 - protein, 326 aa, Mycobacterium tuberculosis H37Rv
MTPRPRALVTAPLRGPGFAQLRRLADVVYDPWIDQRPLRIYSAEQLADRITAVAADVLVVESDSVGGPVFERGLRVVAATRGDPSNVDIPGATAAGIPVLHTPARNADAVAEMTVALLLAVARHLIPADADVRSGNIFRDGTIPYQRFRGAEIAGLTAGLVGLGAVGRAVRWRLSGLGLRVIAHDPYRDDAGHSLDELLAEADIVSMHAAVTDDTIGMIGAQQFAAMRDGAVFLNTARSQLRDTDALVDALRGGKLAAAGLDHFTGEWLPTDHPLVSMPNVVLTPHIGGATWNTEARQARMVADDLGALLSGNRPAHVVNPEVLGS

SEQ ID NO: 12102 - protein, 181 aa, Mycobacterium tuberculosis H37Rv
MRVLLLGPPGAGKGTQAVKLAEKLGIPQISTGELFRRNIEEGTKLGVEAKRYLDAGDLVPSDLTNELVDDRLNNPDAANGFILDGYPRSVEQAKALHEMLERRGTDIDAVLEFRVSEEVLLERLKGRGRADDTDDVILNRMKVYRDETAPLLEYYRDQLKTVDAVGTMDEVFARALRALGK

SEQ ID NO: 12103 - protein, 294 aa, Mycobacterium tuberculosis H37Rv
MTTIAFLGLGNMGAPMSANLVGAGHVVRGFDPAPTAASGAAAHGVAVFRSAPEAVAEADVVITMLPTGEVVRRCYTDVLAAARPATLFIDSSTISVTDAREVHALAESHGMLQLDAPVSGGVKGAAAATLAFMVGGDESTLRRARPVLEPMAGKIIHCGAAGAGQAAKVCNNMVLAVQQIAIAEAFVLAEKLGLSAQSLFDVITGATGNCWAVHTNCPVPGPVPTSPANNDFKPGFSTALMNKDLGLAMDAVAATGATAPLGSHAADIYAKFAADHADLDFSAVIHTLRARADA

SEQ ID NO: 12104 - protein, 489 aa, Mycobacterium tuberculosis H37Rv
MALWGDGISALLIDGKLSDGRAGTFPTVNPATEEVLGVAADADAEDMGRAIEAARRAFDSTDWSRNTELRVRCVRQLRDAMQQHVEELRELTISEVGAPRMLTASAQLEGPVGDLSFAADTAESYPWKQDLGEASPLGIATRRTLAREAVGVVGAITPWNFPHQINLAKLGPALAAGNTVVLKPAPDTPWCAAALGEIIVEHTDFPPGVVNIVTSSSHALGALLAKDPRVDMISFTGSTATGRAVMADAAATIKKVFLELGGKSAFVVLDDADLAAASAVSAFSACMHAGQGCAITTRLVVPRARYEEAVAIAAATMSSIRPGDPNDPGTVCGPLISARQRDRVQGYLDLAVAEGGRFACGGARPADREVGFYIEPTVIAGLTNDARVAREEIFGPVLTVIAHDGDDDAVRIANDSPYGLSGTVYGADPQRAARIASRLRVGTVNVNGGVWYCADAPFGGYKQSGIGREMGLLGFEEYLEAKLIATAAN

SEQ ID NO: 12105 - protein, 295 aa, Mycobacterium tuberculosis H37Rv
MTAHPETPRLGYIGLGNQGAPMAKRLLDWPGGLTVFDVRVEAMAPFVEGGATAAASVSDVAEADIISITVFDDAQVSSVITADNGLATHAKPGTIVAIHSTIADTTAVDLAEKLKPQGIHIVDAPVSGGAAAAAKGELAVMVGADDEAFQRIKEPFSRWASLLIHAGEPGAGTRMKLARNMLTFVSYAAAAEAQRLAEACGLDLVALGKVVRHSDSFTGGAGAIMFRNTTAPMEPADPLRPLLEHTRGLGEKDLSLALALGEVVSVDLPLAQLALQRLAAGLGVPHPDTEPAKET

SEQ ID NO: 12106 - protein, 429 aa, Mycobacterium tuberculosis H37Rv
MPIIEQVRAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 12107 - protein, 340 aa, Mycobacterium tuberculosis H37Rv
MQLGMIGLGRMGANIVRRLAKGGHDCVVYDHDPDAVKAMAGEDRTTGVASLRELSQRLSAPRVVWVMVPAGNITTAVIEELANTLEAGDIVIDGGNTYYRDDLRHEKLLFKKGIHLLDCGTSGGVWGRERGYCLMIGGDGDAFARAEPIFATVAPGVAAAPRTPGRDGEVAPSEQGYLHCGPCGSGHFVKMVHNGIEYGMMASLAEGLNILRNADVGTRVQHGDAETAPLPNPECYQYDFDIPEVAEVWRRGSVIGSWLLDLTAIALRESPDLAEFSGRVSDSGEGRWTAIAAIDEGVPAPVLTTALQSRFASRDLDDFANKALSAMRKQFGGHAEKPAN

SEQ ID NO: 12108 - protein, 323 aa, Mycobacterium tuberculosis H37Rv
MTRYDSLLQALGNTPLVGLQRLSPRWDDGRDGPHVRLWAKLEDRNPTGSIKDRPAVRMIEQAEADGLLRPGATILEPTSGNTGISLAMAARLKGYRLICVMPENTSVERRQLLELYGAQIIFSAAEGGSNTAVATAKELAATNPSWVMLYQYGNPANTDSHYCGTGPELLADLPEITHFVAGLGTTGTLMGTGRFLREHVANVKIVAAEPRYGEGVYALRNMDEGFVPELYDPEILTARYSVGAVDAVRRTRELVHTEGIFAGISTGAVLHAALGVGAGALAAGERADIALVVADAGWKYLSTGAYAGSLDDAETALEGQLWA

SEQ ID NO: 12109 - protein, 492 aa, Mycobacterium tuberculosis H37Rv
MMPDYHALIVGAGFSGIGAAIKLDRAGFSDYLVVEAGDGVGGTWHWNTYPGIAVDIPSFSYQFSFEQSRHWSRTYAPGHELKAYAEHCVDKYGIRSRIRLNTKVLAAEFDDEHSLWRVQTDPGGEITARFLISACGILTVPKLPDIDGVDSFEGVTMHTARWDHTQDLTGKRVGIIGTGASAVQVIPEMAPIVSHLTVFQRTPIWCFPKFDVPLPTAVRWAMRIPGGKAVHRLLSQAFVEATFPIAAHYFAVFPLAKHMESAGRRYLRQQVHDPVVREQLTPRYAVGCKRPGFHNTYLSTFNRDNVRLVTEPIDKITPTAVATTDGASHEIDVLVLATGFKVLDTDSIPTYAVTGTGGASLSRFWDEHRLQAYEGVSVPGYPNFFTVFGPYGYVGSSYFALIETQAHHIIRCLKRARRTGATRIEVTEEANARYFAEVMRRRHRQVFWQDSCRLANSYYFDKNGDVPLRPTTTVEAYWRSRRFDLGDYRISS

SEQ ID NO: 12110 - protein, 319 aa, Mycobacterium tuberculosis H37Rv
MTEPTVARPDIDPVLKMLLDTFPVTFTAADGVEVARARLRQLKTPPELLPELRIEERTVGYDGLTDIPVRVYWPPVVRDNLPVVVYYHGGGWSLGGLDTHDPVARAHAVGAQAIVVSVDYRLAPEHPYPAGIDDSWAALRWVGENAAELGGDPSRIAVAGDSAGGNISAVMAQLARDVGGPPLVFQLLWYPTTMADLSLPSFTENADAPILDRDVIDAFLAWYVPGLDISDHTMLPTTLAPGNADLSGLPPAFIGTAEHDPLRDDGACYAELLTAAGVSVELSNEPTMVHGYVNFALVVPAAAEATGRGLAALKRALHA

SEQ ID NO: 12111 - protein, 320 aa, Mycobacterium tuberculosis H37Rv
MPSLDNTADEKPAIDPILLKVLDAVPFRLSIDDGIEAVRQRLRDLPRQPVHPELRVVDLAIDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 12112 - protein, 232 aa, Mycobacterium tuberculosis H37Rv
MSLMAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 12113 - protein, 412 aa, Mycobacterium tuberculosis H37Rv
MSVANLKDLLAEGVSGRGVLVRSDLNVPLDEDGTITDAGRIIASAPTLKALLDADAKVVVAAHLGRPKDGPDPTLSLAPVAVALGEQLGRHVQLAGDVVGADALARAEGLTGGDILLLENIRFDKRETSKNDDDRRALAKQLVELVGTGGVFVSDGFGVVHRKQASVYDIATLLPHYAGTLVADEMRVLEQLTSSTQRPYAVVLGGSKVSDKLGVIESLATKADSIVIGGGMCFTFLAAQGFSVGTSLLEDDMIEVCRGLLETYHDVLRLPVDLVVTEKFAADSPPQTVDVGAVPNGLMGLDIGPGSIKRFSTLLSNAGTIFWNGPMGVFEFPAYAAGTRGVAEAIVAATGKGAFSVVGGGDSAAAVRAMNIPEGAFSHISTGGGASLEYLEGKTLPGIEVLSREQPTGGVL

SEQ ID NO: 12114 - protein, 261 aa, Mycobacterium tuberculosis H37Rv
MSRKPLIAGNWKMNLNHYEAIALVQKIAFSLPDKYYDRVDVAVIPPFTDLRSVQTLVDGDKLRLTYGAQDLSPHDSGAYTGDVSGAFLAKLGCSYVVVGHSERRTYHNEDDALVAAKAATALKHGLTPIVCIGEHLDVREAGNHVAHNIEQLRGSLAGLLAEQIGSVVIAYEPVWAIGTGRVASAADAQEVCAAIRKELASLASPRIADTVRVLYGGSVNAKNVGDIVAQDDVDGGLVGGASLDGEHFATLAAIAAGGPLP

SEQ ID NO: 12115 - protein, 2108 aa, Mycobacterium tuberculosis H37Rv
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGEPPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAAFDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 12116 - protein, 270 aa, Mycobacterium tuberculosis H37Rv
MVAVEQSEASRLGPVFDSCRANNRAALIGYLPTGYPDVPASVAAMTALVESGCDIIEVGVPYSDPGMDGPTIARATEAALRGGVRVRDTLAAVEAISIAGGRAVVMTYWNPVLRYGVDAFARDLAAAGGLGLITPDLIPDEAQQWLAASEEHRLDRIFLVAPSSTPERLAATVEASRGFVYAASTMGVTGARDAVSQAAPELVGRVKAVSDIPVGVGLGVRSRAQAAQIAQYADGVIVGSALVTALTEGLPRLRALTGELAAGVRLGMSA

SEQ ID NO: 12117 - protein, 472 aa, Mycobacterium tuberculosis H37Rv
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLEKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 12118 - protein, 400 aa, Mycobacterium tuberculosis H37Rv
MTGASTTTATMRQRWQAVMMNNYGTPPIALASGDGAVVTDVDGRTYIDLLGGIAVNVLGHRHPAVIEAVTRQMSTLGHTSNLYATEPGIALAEELVALLGADQRTRVFFCNSGAEANEAAFKLSRLTGRTKLVAAHDAFHGRTMGSLALTGQPAKQTPFAPLPGDVTHVGYGDVDALAAAVDDHTAAVFLEPIMGESGVVVPPAGYLAAARDITARRGALLVLDEVQTGMGRTGAFFAHQHDGITPDVVTLAKGLGGGLPIGACLAVGPAAELLTPGLHGSTFGGNPVCAAAALAVLRVLASDGLVRRAEVLGKSLRHGIEALGHPLIDHVRGRGLLLGIALTAPHAKDAEATARDAGYLVNAAAPDVIRLAPPLIIAEAQLDGFVAALPAILDRAVGAP

SEQ ID NO: 12119 - protein, 430 aa, Mycobacterium tuberculosis H37Rv
MRYPLGEALLALYRWRGPLINAGVGGHGYTYLLGAEANRFVFANADAFSWSQTFESLVPVDGPTALIVSDGADHRRRRSVVAPGLRHHHVQRYVATMVSNIDTVIDGWQPGQRLDIYQELRSAVRRSTAESLFGQRLAVHSDFLGEQLQPLLDLTRRPPQVMRLQQRVNSPGWRRAMAARKRIDDLIDAQIADARTAPRPDDHMLTTLISGCSEEGTTLSDNEIRDSIVSLITAGYETTSGALAWAIYALLTVPGTWESAASEVARVLGGRVPAADDLSALTYLNGVVHETLRLYSPGVISARRVLRDLWFDGHRIRAGRLLIFSAYVTHRLPEIWPEPTEFRPLRWDPNAADYRKPAPHEFIPFSGGLHRCIGAVMATTEMTVILARLVARAMLQLPAQRTHRIRAANFAALRPWPGLTVEIRKSAPAQ

SEQ ID NO: 12120 - protein, 428 aa, Mycobacterium tuberculosis H37Rv
MSPIWSNWPGEQVCAPSAIVRPTSEAELADVIAQAAKRGERVRAVGSGHSFTDIACTDGVMIDMTGLQRVLDVDQPTGLVTVEGGAKLRALGPQLAQRRLGLENQGDVDPQSITGATATATHGTGVRFQNLSARIVSLRLVTAGGEVLSLSEGDDYLAARVSLGALGVISQVTLQTVPLFTLHRHDQRRSLAQTLERLDEFVDGNDHFEFFVFPYADKALTRTMHRSDEQPKPTPGWQRMVGENFENGGLSLICQTGRRFPSVAPRLNRLMTNMMSSSTVQDRAYKVFATQRKVRFTEMEYAIPRENGREALQRVIDLVRRRSLPIMFPIEVRFSAPDDSFLSTAYGRDTCYIAVHQYAGMEFESYFRAVEEIMDDYAGRPHWGKRHYQTAATLRERYPQWDRFAAVRDRLDPDRVFLNDYTRRVLGP

SEQ ID NO: 12121 - protein, 479 aa, Mycobacterium tuberculosis H37Rv
MMRFLDGHPPGYDLTYNDVFIVPNRSEVASRFDVDLSTADGSGTTIPVVVANMTAVAGRRMAETVARRGGIVILPQDLPIPAVKQTVAFVKSRDLVLDTPVTLAPDDSVSDAMALIHKRAHGVAVVILEGRPIGLVRESSCLGVDRFTRVRDIAVTDYVTAPAGTEPRKIFDLLEHAPVDVAVLTDADGTLAGVLSRTGAIRAGIYTPATDSAGRLRIGAAVGINGDVGAKARALAEAGVDVLVIDTAHGHQVKTLDAIKAVSALDLGLPLAAGNVVSAEGTRDLLKAGANVVKVGVGPGAMCTTRMMTGVGRPQFSAVLECASAARQLGGHIWADGGIRHPRDVALALAAGASNVMIGSWFAGTYESPGDLMRDRDDQPYKESYGMASKRAVVARTGADNPFDRARKALFEEGISTSRMGLDPDRGGVEDLIDHITSGVRSTCTYVGASNLAELHERAVVGVQSGAGFAEGHPLPAGW

SEQ ID NO: 12122 - protein, 346 aa, Mycobacterium tuberculosis H37Rv
MVSPATTATMSAWQVRRPGPMDTGPLERVTTRVPRPAPSELLVAVHACGVCRTDLHVTEGDLPVHRERVIPGHEVVGEVIEVGSAVGAAAGGEFDRGDRVGIAWLRHTCGVCKYCRRGSENLCPQSRYTGWDADGGYAEFTTVPAAFAHHLPSGYSDSELAPLLCAGIIGYRSLLRTELPPGGRLGLYGFGGSAHITAQVALAQGAEIHVMTRGARARKLALQLGAASAQDAADRPPVPLDAAILFAPVGDLVLPALEALDRGGILAIAGIHLTDIPDLNYQQHLFQERQIRSVTSNTRADARAFFDFAAQHHIEVTTPEYPLGQADRALGDLSAGRIAGAAVLLI

SEQ ID NO: 12123 - protein, 411 aa, Mycobacterium tuberculosis H37Rv
MASSTTFVIVGGGLAGAKAVEALRRSDFGGRIILFGDEEHLPYDRPPLSKEFLAGKKSLSDFTIQTSDWYRDHDVDVRLGVRVSSLDRSAHTVELPDGAAVRYDKLLLATGSAPRRPPIPGSDAAGVHYLRSYNDAVALNSVLVQGSSLAVVGAGWIGLEVAASARQRGVDVTVVETAIQPLLAALGEAVGKVFADLHRDQGVDLRLQTQLEEITAADGKATGLKMRDGSTVAADAVLVAVGAKPNVELAQQAGLAMGEGGVLVDASLRTSDPDIYAVGDIAAAEHPLLGTRVRTEHWANALKQPAVAAAGMLGRPGEYAELPYLFTDQYDLGMEYVGHAPSCDRVVFRGNVAGREFLSFWLDGDSRVLAGMNVNVWDVVDDVKGLIRSGNPVDVDRLVDPQWPLADLTTN

SEQ ID NO: 12124 - protein, 450 aa, Mycobacterium tuberculosis H37Rv
MTATPLAAAAIAQLEAEGVDTVIGTVVNPAGLTQAKTVPIRRTNTFANPGLGASPVWHTFCIDQCSIAFTADISVVGDQRLRIDLSALRIIGDGLAWAPAGFFEQDGTPVPACSRGTLSRIEAALADAGIDAVIGHEVEFLLVDADGQRLPSTLWAQYGVAGVLEHEAFVRDVNAAATAAGIAIEQFHPEYGANQFEISLAPQPPVAAADQLVLTRLIIGRTARRHGLRVSLSPAPFAGSIGSGAHQHFSLTMSEGMLFSGGTGAAGMTSAGEAAVAGVLRGLPDAQGILCGSIVSGLRMRPGNWAGIYACWGTENREAAVRFVKGGAGSAYGGNVEVKVVDPSANPYLASAAILGLALDGMKTKAVLPSETTVDPTQLSDVDRDRAGILRLAADQADAIAVLDSSKLLRCILGDPVVDAVVAVRQLEHERYGDLDPAQLADKFRMAWSV

SEQ ID NO: 12125 - protein, 422 aa, Mycobacterium tuberculosis H37Rv
MAAPRLTGDQRNAFMASFLGWTMDAFDYFLVVLVYADIATTFHHTKTDVAFLTTATLAMRPVGALLFGLWADRVGRRVPLMVDVSFYSVIGFLCAFAPNFTVLVILRLLYGIGMGGEWGLGAALSMEKVPAERRGVFSGLLQEGYAFGYLLASVAALVVMNWLGLSWRWLFGLSIIPALISLIIRYRVKESEVWEAAQDRMRLTKTRIRDVLGNPAIVRRFVYLVLLMTAFNWMSHGTQDVYPTFLTATTDHGAGLSSLTARWIVVIYNIGAIIGGLAFGTLSQRFSRRYTIVFCAALGLPIVPLFAYSRTAAMLCLGSFLMQVFVQGAWGVIPAHLTEMSPDAIRGVYPGVTYQLGNLLAAFNLPIQERLAESHGYPFALAATIVPVLLVVAVLTAIGKDATGIRFGTTETAFLVRHRNRH

SEQ ID NO: 12126 - protein, 334 aa, Mycobacterium tuberculosis H37Rv
MRAVVITKHGDPSVLQVRQRPDPPPPGPGQLRVAVRAAGVNFADHLARVGLYPDAPKLPAVVGYEVAGTVEAVGDGVDPNRVGERVLAGTRFGGYCEIVNVAATDSVVLPDALSFEQGAAVPVNYATAWAALHGYGSLRAGERVLIHAAAGGVGIAAVQFAKAAKAEVHGTASPQKHQKLAEFGVDRAIDYRRDGWWQGLGPYDVVLDALGGTSLRRSYTLLRPGGRLVGYGISNMQHGEKRSMRRVAPHALSMLRGFNLMKQLEESKTVIGLNMLRLWDDRRTLEPWIAPLTKALNDGTILPIVHAIVPFAEAPEAHRILAARENVDKVVLVP

SEQ ID NO: 12127 - protein, 478 aa, Mycobacterium tuberculosis H37Rv
MTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 12128 - protein, 446 aa, Mycobacterium tuberculosis H37Rv
MDRQKEFVLRTLEERDIRFVRLWFTDVLGFLKSVAIAPAELEGAFEEGIGFDGSSIEGFARVSESDTVAHPDPSTFQVLPWATSSGHHHSARMFCDITMPDGSPSWADPRHVLRRQLTKAGELGFSCYVHPEIEFFLLKPGPEDGSVPVPVDNAGYFDQAVHDSALNFRRHAIDALEFMGISVEFSHHEGAPGQQEIDLRFADALSMADNVMTFRYVIKEVALEEGARASFMPKPFGQHPGSAMHTHMSLFEGDVNAFHSADDPLQLSEVGKSFIAGILEHACEISAVTNQWVNSYKRLVQGGEAPTAASWGAANRSALVRVPMYTPHKTSSRRVEVRSPDSACNPYLTFAVLLAAGLRGVEKGYVLGPQAEDNVWDLTPEERRAMGYRELPSSLDSALRAMEASELVAEALGEHVFDFFLRNKRTEWANYRSHVTPYELRTYLSL

SEQ ID NO: 12129 - protein, 473 aa, Mycobacterium tuberculosis H37Rv
MTIMAPEAVGESLDPRDPLLRLSNFFDDGSVELLHERDRSGVLAAAGTVNGVRTIAFCTDGTVMGGAMGVEGCTHIVNAYDTAIEDQSPIVGIWHSGGARLAEGVRALHAVGQVFEAMIRASGYIPQISVVVGFAAGGAAYGPALTDVVVMAPESRVFVTGPDVVRSVTGEDVDMASLGGPETHHKKSGVCHIVADDELDAYDRGRRLVGLFCQQGHFDRSKAEAGDTDIHALLPESSRRAYDVRPIVTAILDADTPFDEFQANWAPSMVVGLGRLSGRTVGVLANNPLRLGGCLNSESAEKAARFVRLCDAFGIPLVVVVDVPGYLPGVDQEWGGVVRRGAKLLHAFGECTVPRVTLVTRKTYGGAYIAMNSRSLNATKVFAWPDAEVAVMGAKAAVGILHKKKLAAAPEHEREALHDQLAAEHERIAGGVDSALDIGVVDEKIDPAHTRSKLTEALAQAPARRGRHKNIPL

SEQ ID NO: 12130 - protein, 361 aa, Mycobacterium tuberculosis H37Rv
MSQTVRGVIARQKGEPVELVNIVVPDPGPGEAVVDVTACGVCHTDLTYREGGINDEYPFLLGHEAAGIIEAVGPGVTAVEPGDFVILNWRAVCGQCRACKRGRPRYCFDTFNAEQKMTLTDGTELTAALGIGAFADKTLVHSGQCTKVDPAADPAVAGLLGCGVMAGLGAAINTGGVTRDDTVAVIGCGGVGDAAIAGAALVGAKRIIAVDTDDTKLDWARTFGATHTVNAREVDVVQAIGGLTDGFGADVVIDAVGRPETYQQAFYARDLAGTVVLVGVPTPDMRLDMPLVDFFSHGGALKSSWYGDCLPESDFPTLIDLYLQGRLPLQRFVSERIGLEDVEEAFHKMHGGKVLRSVVML

SEQ ID NO: 12131 - protein, 317 aa, Mycobacterium tuberculosis H37Rv
MAKDLVATVPDLSGKLAIITGANSGLGFGLARRLSAAGADVIMAIRNRAKGEAAVEEIRTAVPDAKLTIKALDLSSLASVAALGEQLMADGRPIDLLINNAGVMTPPERVTTADGFELQFGSNHLGHFALTAHLLPLLRAAQRARVVSLSSLAARRGRIHFDDLQFERSYAPMTAYGQSKLAVLMFARELDRRSRAAGWGIISNAAHPGLTKTNLQIAGPSHGRDKPALMERLYKTSWRFAPFLWQEIEEGILPALYAAATPQADGGAFYGPRGRYEVAGGGVREAKVPAAARNDADSKRLWEVSEQLTGVSYPKSR

SEQ ID NO: 12132 - protein, 323 aa, Mycobacterium tuberculosis H37Rv
MKYLDVDGIGQVSRIGLGTWQFGSREWGYGDRYATGAARDIVKRARALGVTLFDTAEIYGLGKSERILGEALGDDRTEVVVASKVFPVAPFPAVIKNRERASARRLQLNRIPLYQIHQPNPVVPDSVIMPGMRDLLDSGDIGAAGVSNYSLARWRKADAALGRPVVSNQVHFSLAHPDALEDLVPFAELENRIVIAYSPLAQGLLGGKYGLENRPGGVRALNPLFGTENLRRIEPLLATLRAIAVDVDAKPAQVALAWLISLPGVVAIPGASSVEQLEFNVAAADIELSAQSRDALTDAARAFRPVSTGRFLTDMVREKVSRR

SEQ ID NO: 12133 - protein, 382 aa, Mycobacterium tuberculosis H37Rv
MARDYYGLLGVSKNASDADIKRAYRKLARELHPDVNPDEAAQAKFKEISVAYEVLSDPDKRRIVDLGGDPLESAAAGGNGFGGFGGLGDVFEAFFGGGFGGGAASRGPIGRVRPGSDSLLRMRLDLEECATGVTKQVTVDTAVLCDRCQGKGTNGDSVPIPCDTCGGRGEVQTVQRSLLGQMLTSRPCPTCRGVGVVIPDPCQQCMGDGRIRARREISVKIPAGVGDGMRVRLAAQGEVGPGGGPAGDLYVEVHEQAHDVFVREGDHLHCTVSVPMVDAALGVTVTVDAILDGLSEITIPPGTQPGSVITLRGRGMPHLRSNTRGDLHVHVEVVVPTRLDHQDIELLRELKGRRDREVAEVRSTHAAAGGLFSRLRETFTGR

SEQ ID NO: 12134 - protein, 248 aa, Mycobacterium tuberculosis H37Rv
MDKVVATAAEAVADIANGSSLAVGGFGLCGIPEALIAALVDSGVTDLETVSNNCGIDGVGLGLLLQHKRIRRTVSSYVGENKEFARQFLAGELEVELTPQGTLAERLRAGGMGIPAFYTPAGVGTQVADGGLPWRYDASGGVAVVSPAKETREFDGVTYVLERGIRTDFALVHAWQGDRHGNLMYRHAAANFNPECASAGRITIAEVEHLVEPGEIDPATVHTPGVFVHRVVHVPNPAKKIERETVRQ

SEQ ID NO: 12135 - protein, 449 aa, Mycobacterium tuberculosis H37Rv
MASLQQSRRLVTEIPGPASQALTHRRAAAVSSGVGVTLPVFVARAGGGIVEDVDGNRLIDLGSGIAVTTIGNSSPRVVDAVRTQVAEFTHTCFMVTPYEGYVAVAEQLNRITPGSGPKRSVLFNSGAEAVENAVKIARSYTGKPAVVAFDHAYHGRTNLTMALTAKSMPYKSGFGPFAPEIYRAPLSYPYRDGLLDKQLATNGELAAARAIGVIDKQVGANNLAALVIEPIQGEGGFIVPAEGFLPALLDWCRKNHVVFIADEVQTGFARTGAMFACEHEGPDGLEPDLICTAKGIADGLPLSAVTGRAEIMNAPHVGGLGGTFGGNPVACAAALATIATIESDGLIERARQIERLVTDRLTTLQAVDDRIGDVRGRGAMIAVELVKSGTTEPDAGLTERLATAAHAAGVIILTCGMFGNIIRLLPPLTIGDELLSEGLDIVCAILADL

SEQ ID NO: 12136 - protein, 468 aa, Mycobacterium tuberculosis H37Rv
MREYDIVVIGSGPGGQKAAIASAKLGKSVAIVERGRMLGGVCVNTGTIPSKTLREAVLYLTGMNQRELYGASYRVKDRITPADLLARTQHVIGKEVDVVRNQLMRNRVDLIVGHGRFIDPHTILVEDQARREKTTVTGDYIIIATGTRPARPSGVEFDEERVLDSDGILDLKSLPSSMVVVGAGVIGIEYASMFAALGTKVTVVEKRDNMLDFCDPEVVEALKFHLRDLAVTFRFGEEVTAVDVGSAGTVTTLASGKQIPAETVMYSAGRQGQTDHLDLHNAGLEVQGRGRIFVDDRFQTKVDHIYAVGDVIGFPALAATSMEQGRLAAYHAFGEPTDGITELQPIGIYSIPEVSYVGATEVELTKSSIPYEVGVARYRELARGQIAGDSYGMLKLLVSTEDLKLLGVHIFGTSATEMVHIGQAVMGCGGSVEYLVDAVFNYPTFSEAYKNAALDVMNKMRALNQFRR

SEQ ID NO: 12137 - protein, 245 aa, Mycobacterium tuberculosis H37Rv
MRVGVLGAKGKVGATMVRAVAAADDLTLSAELDAGDPLSLLTDGNTEVVIDFTHPDVVMGNLEFLIDNGIHAVVGTTGFTAERFQQVESWLVAKPNTSVLIAPNFAIGAVLSMHFAKQAARFFDSAEVIELHHPHKADAPSGTAARTAKLIAEARKGLPPNPDATSTSLPGARGADVDGIPVHAVRLAGLVAHQEVLFGTEGETLTIRHDSLDRTSFVPGVLLAVRRIAERPGLTVGLEPLLDLH

SEQ ID NO: 12138 - protein, 455 aa, Mycobacterium tuberculosis H37Rv
MSTTQLINPATEEVLASVDHTDANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 12139 - protein, 457 aa, Mycobacterium tuberculosis H37Rv
MTGPGSPPLAWTELERLVAAGDVDTVIVAFTDMQGRLAGKRISGRHFVDDIATRGVECCSYLLAVDVDLNTVPGYAMASWDTGYGDMVMTPDLSTLRLIPWLPGTALVIADLVWADGSEVAVSPRSILRRQLDRLKARGLVADVATELEFIVFDQPYRQAWASGYRGLTPASDYNIDYAILASSRMEPLLRDIRLGMAGAGLRFEAVKGECNMGQQEIGFRYDEALVTCDNHAIYKNGAKEIADQHGKSLTFMAKYDEREGNSCHIHVSLRGTDGSAVFADSNGPHGMSSMFRSFVAGQLATLREFTLCYAPTINSYKRFADSSFAPTALAWGLDNRTCALRVVGHGQNIRVECRVPGGDVNQYLAVAALIAGGLYGIERGLQLPEPCVGNAYQGADVERLPVTLADAAVLFEDSALVREAFGEDVVAHYLNNARVELAAFNAAVTDWERIRGFERL

SEQ ID NO: 12140 - protein, 2188 aa, Mycobacterium tuberculosis H37Rv
MTAATPDRRAIITEALHKIDDLTARLEIAEKSSSEPIAVIGMGCRFPGGVNNPEQFWDLLCAGRSGIVRVPAQRWDADAYYCDDHTVPGTICSTEGGFLTSWQPDEFDAEFFSISPREAAAMDPQQRLLIEVAWEALEDAGVPQHTIRGTQTSVFVGVTAYDYMLTLAGRLRPVDLDAYIPTGNSANFAAGRLAYILGARGPAVVIDTACSSSLVAVHLACQSLRGRESDMALVGGTNLLLSPGPSIACSRWGMLSPEGRCKTFDASADGYVRGEGAAVVVLKRLDDAVRDGNRILAVVRGSAVNQDGASSGVTVPNGPAQQALLAKALTSSKLTAADIDYVEAHGTGTPLGDPIELDSLSKVFSDRAGSDQLVIGSVKTNLGHLEAAAGVAGLMKAVLAVHNGYIPRHLNFHQLTPHASEAASRLRIAADGIDWPTTGRPRRAGVSSFGVSGTNAHVVIEQAPDPMAAAGTEPQRGPVPAVSTLVVFGKTAPRVAATASVLADWLDGPGAAVPLADVAHTLNHHRARQTRFGTVAAVDRRQAVIGLRALAAGQSAPGVVAPREGSIGGGTVFVYSGRGSQWAGMGRQLLADEPAFAAAIAELEPEFVAQGGFSLRDVIAGGKELVGIEQIQLGLIGMQLALTALWRSYGVTPDAVIGHSMGEVAAAVVAGALTPAQGLRVTAVRSRLMAPLSGQGTMALLELDAEATEALIADYPEVSLGIYASPRQTVISGPPLLIDELIDKVRQQNGFATRVNIEVAPHNPAMDALQPAMRSELADLTPQPPTIPIISTTYADLGISLGSGPRFDAEHWATNMRNPVRFHQAIAHAGADHHTFIEISAHPLLTHSISDTLRASYDVDNYLSIGTLQRDAHDTLEFHTNLNTTHTTHPPQTPHPPEPHPVLPTTPWQHTQHWITATSAAYHRPDTHPLLGVGVTDPTNGTRVWESELDPDLLWLADHVIDDLVVLPGAAYAEIALAAATDTFAVEQDQPWMISELDLRQMLHVTPGTVLVTTLTGDEQRCQVEIRTRSGSSGWTTHATATVARAEPLAPLDHEGQRREVTTADLEDQLDPDDLYQRLRGAGQQHGPAFQGIVGLAVTQAGVARAQVRLPASARTGSREFMLHPVMMDIALQTLGATRTATDLAGGQDARQGPSSNSALVVPVRFAGVHVYGDITRGVRAVGSLAAAGDRLVGEVVLTDANGQPLLVVDEVEMAVLGSGSGATELTNRLFMLEWEPAPLEKTAEATGALLLIGDPAAGDPLLPALQSSLRDRITDLELASAADEATLRAAISRTSWDGIVVVCPPRANDESMPDEAQLELARTRTLLVASVVETVTRMGARKSPRLWIVTRGAAQFDAGESVTLAQTGLRGIARVLTFEHSELNTTLVDIEPDGTGSLAALAEELLAGSEADEVALRDGQRYVNRLVPAPTTTSGDLAAEARHQVVNLDSSGASRAAVRLQIDQPGRLDALNVHEVKRGRPQGDQVEVRVVAAGLNFSDVLKAMGVYPGLDGAAPVIGGECVGYVTAIGDEVDGVEVGQRVIAFGPGTFGTHLGTIADLVVPIPDTLADNEAATFGVAYLTAWHSLCEVGRLSPGERVLIHSATGGVGMAAVSIAKMIGARIYTTAGSDAKREMLSRLGVEYVGDSRSVDFADEILELTDGYGVDVVLNSLAGEAIQRGVQILAPGGRFIELGKKDVYADASLGLAALAKSASFSVVDLDLNLKLQPARYRQLLQHILQHVADGKLEVLPVTAFSLHDAADAFRLMASGKHTGKIVISIPQHGSIEAIAAPPPLPLVSRDGGYLIVGGMGGLGFVVARWLAEQGAGLIVLNGRSAPSDEVAAAIAELNASGSRIEVITGDITEPDTAERLVRAVEDAGFRLAGVVHSAMVLADEIVLNMTDSAARRVFAPKVTGSWRLHVATAARDVDWWLTFSSAAALLGTPGQGAYAAANSWVDGLVAHRRSAGLPAVGINWGPWADVGRAQFFKDLGVEMINAEQGLAAMQAVLTADRGRTGVFSLDARQWFQSFPAVAGSSLFAKLHDSAARKSGQRRGGGAIRAQLDALDAAERPGHLASAIADEIRAVLRSGDPIDHHRPLETLGLDSLMGLELRNRLEASLGITLPVALVWAYPTISDLATALCERMDYATPAAAQEISDTEPELSDEEMDLLADLVDASELEAATRGES

SEQ ID NO: 12141 - protein, 376 aa, Mycobacterium tuberculosis H37Rv
MTKSLPGVADLRLGANHPRMWTRRVQGTVVNVGVKVLPWIPTPAKRILSAGRSVIIDGNTLDPTLQLMLSTSRIFGVDGLAVDDDIVASRAHMRAICEAMPGPQIHVDVTDLSIPGPAGEIPARHYRPSGGGATPLLVFYHGGGWTLGDLDTHDALCRLTCRDADIQVLSIDYRLAPEHPAPAAVEDAYAAFVWAHEHASDEFGALPGRVAVGGDSAGGNLSAVVCQLARDKARYEGGPTPVLQWLLYPRTDFTAQTRSMGLFGNGFLLTKRDIDWFHTQYLRDSDVDPADPRLSPLLAESLSGLAPALIAVAGFDPLRDEGESYAKALRAAGTAVDLRYLGSLTHGFLNLFQLGGGSAAGTNELISALRAHLSRV

SEQ ID NO: 12142 - protein, 492 aa, Mycobacterium tuberculosis H37Rv
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 12143 - protein, 368 aa, Mycobacterium tuberculosis H37Rv
MKTTAAVLFEAGKPFELMELDLDGPGPGEVLVKYTAAGLCHSDLHLTDGDLPPRFPIVGGHEGSGVIEEVGAGVTRVKPGDHVVCSFIPNCGTCRYCCTGRQNLCDMGATILEGCMPDGSFRFHSQGTDFGAMCMLGTFAERATVSQHSVVKVDDWLPLETAVLVGCGVPSGWGTAVNAGNLRAGDTAVIYGVGGLGINAVQGATAAGCKYVVVVDPVAFKRETALKFGATHAFADAASAAAKVDELTWGQGADAALILVGTVDDEVVSAATAVIGKGGTVVITGLADPAKLTVHVSGTDLTLHEKTIKGSLFGSCNPQYDIVRLLRLYDAGQLMLDELVTTTYNLEQVNQGYQDLRDGKNIRGVIVH

SEQ ID NO: 12144 - protein, 503 aa, Mycobacterium tuberculosis H37Rv
MKNIGWMLRQRATVSPRLQAYVEPSTDVRMTYAQMNALANRCADVLTALGIAKGDRVALLMPNSVEFCCLFYGAAKLGAVAVPINTRLAAPEVSFILSDSGSKVVIYGAPSAPVIDAIRAQADPPGTVTDWIGADSLAERLRSAAADEPAVECGGDDNLFIMYTSGTTGHPKGVVHTHESVHSAASSWASTIDVRYRDRLLLPLPMFHVAALTTVIFSAMRGVTLISMPQFDATKVWSLIVEERVCIGGAVPAILNFMRQVPEFAELDAPDFRYFITGGAPMPEALIKIYAAKNIEVVQGYALTESCGGGTLLLSEDALRKAGSAGRATMFTDVAVRGDDGVIREHGEGEVVIKSDILLKEYWNRPEATRDAFDNGWFRTGDIGEIDDEGYLYIKDRLKDMIISGGENVYPAEIESVIIGVPGVSEVAVIGLPDEKWGEIAAAIVVADQNEVSEQQIVEYCGTRLARYKLPKKVIFAEAIPRNPTGKILKTVLREQYSATVPK

SEQ ID NO: 12145 - protein, 229 aa, Mycobacterium tuberculosis H37Rv
MITLDHVTKQYKSSARPALDDINVKIDKGEFVFLIGPSGSGKSTFMRLLLAAETPTSGDVRVSKFHVNKLRGRHVPKLRQVIGCVFQDFRLLQQKTVYDNVAFALEVIGKRTDAINRVVPEVLETVGLSGKANRLPDELSGGEQQRVAIARAFVNRPLVLLADEPTGNLDPETSRDIMDLLERINRTGTTVLMATHDHHIVDSMRQRVVELSLGRLVRDEQRGVYGMDR

SEQ ID NO: 12146 - protein, 495 aa, Mycobacterium tuberculosis H37Rv
MAGRRRMKSVEQSIADTDEPTTRLRKDLTWWDLVVFGVSVVIGAGIFTVTASTAGDITGPAIWISFLIAAATCALAALCYAEFASTLPVAGSAYTFSYATFGEFLAWVIGWNLVLELAMGAAVVAKGWSSYLGTVFGFGNGTGHLGSLQLDWGALVIVTLVATLIALGTKLSSRFSAVVTAIKVSVVVLVVVVGAFYIRAANYSPFIPEPEVQHHGGGLDQSVFSLLTGAQGSHYGWYGVLAGASIVFFAFIGFDIVATMAEETKRPQRDVPRGILASLGVVTLLYVAVSVVLSGMVPYTQLRTVPGRGPANLATAFQANGVYWASGIISVGALAGLTTVVMVLMLGQCRVLFAMARDGLVPRQLAKTGSRGTPVRVTVLVAVLVATTASVFPITKLEEMVNVGTLFAFILVSAGVVVLRRTRPDLQRGFTAPWVPLLPIAAVCACLWLMLNLTALTWIRFGIWLVAGTAIYVGYGRRHSAQGLRQARESATRRC

SEQ ID NO: 12147 - protein, 493 aa, Mycobacterium tuberculosis H37Rv
MVTRIVILGGGPAGYEAALVAATSHPETTQVTVIDCDGIGGAAVLDDCVPSKTFIASTGLRTELRRAPHLGFHIDFDDAKISLPQIHARVKTLAAAQSADITAQLLSMGVQVIAGRGELIDSTPGLARHRIKATAADGSTSEHEADVVLVATGASPRILPSAQPDGERILTWRQLYDLDALPDHLIVVGSGVTGAEFVDAYTELGVPVTVVASQDHVLPYEDADAALVLEESFAERGVRLFKNARAASVTRTGAGVLVTMTDGRTVEGSHALMTIGSVPNTSGLGLERVGIQLGRGNYLTVDRVSRTLATGIYAAGDCTGLLPLASVAAMQGRIAMYHALGEGVSPIRLRTVAATVFTRPEIAAVGVPQSVIDAGSVAARTIMLPLRTNARAKMSEMRHGFVKIFCRRSTGVVIGGVVVAPIASELILPIAVAVQNRITVNELAQTLAVYPSLSGSITEAARRLMAHDDLDCTAAQDAAEQLALVPHHLPTSN

SEQ ID NO: 12148 - protein, 438 aa, Mycobacterium tuberculosis H37Rv
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKQKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 12149 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 12150 - protein, 396 aa, Mycobacterium tuberculosis H37Rv
MAPGSCEAPDVFNPAKLGPLTLRNRVIKAATFEARTPDALVTDDLIEYHRLPAAGGVAMTTVAYCAVSPGGRTGGNQIWMRPHAVPGLRRLTEAIHAEGAAISAQIGHAGPVADARSNQATALAPVRFFNPIAMRFAQKATREDIDDVLAAHAHAARLAVDAGFDAVEIHLGHNYLASAFLSPLLNRRDDEFGGSLQNRAKVARGLVMAVRRAVRQQVAVTAKLNMTDGIRGGITVDEALTTARWLQDDGGLDAIELTAGSSLVNPMYLFRGDAPVKEFAAAFKPPLRWGIRMTGHRFFREYPYRDAYLLREARLFRAELTIPLILLGGITNRTTMDLAMAEGFEFVAMARALLAEPDLVNRIAAEGSQVRSACTHCNQCMATIYRRTHCVVTGAP

SEQ ID NO: 12151 - protein, 391 aa, Mycobacterium tuberculosis H37Rv
MRKLGPVTIDPRRHDAVLFDTTLDATQELVRQLQEVGVGTGVFGSGLDVPIVAAGRLAVRPGRCVVVSAHSAGVTAARESGFALIIGVDRTGCRDALRRDGADTVVTDLSEVSVRTGDRRMSQLPDALQALGLADGLVARQPAVFFDFDGTLSDIVEDPDAAWLAPGALEALQKLAARCPIAVLSGRDLADVTQRVGLPGIWYAGSHGFELTAPDGTHHQNDAAAAAIPVLKQAAAELRQQLGPFPGVVVEHKRFGVAVHYRNAARDRVGEVAAAVRTAEQRHALRVTTGREVIELRPDVDWDKGKTLLWVLDHLPHSGSAPLVPIYLGDDITDEDAFDVVGPHGVPIVVRHTDDGDRATAALFALDSPARVAEFTDRLARQLREAPLRAT

SEQ ID NO: 12152 - protein, 473 aa, Mycobacterium tuberculosis H37Rv
MRHYYSVDTIRAAEAPLLASLPDGALMRRAAFGLATEIGRELTARTGGVVGRRVCAVVGSGDNGGDALWAATFLRRRGAAADAVLLNPDRTHRKALAAFTKSGGRLVESVSAATDLVIDGVVGISGSGPLRPAAAQVFAAVQAAAIPVVAVDIPSGIDVATGAITGPAVHAALTVTFGGLKPVHALADCGRVVLVDIGLDLAHTDVLGFEATDVAARWPVPGPRDDKYTQGVTGVLAGSSTYPGAAVLCTGAAVAATSGMVRYAGTAHAEVLAHWPEVIASPTPAAAGRVQAWVVGPGLGTDEAGAAALWFALDTDLPVLVDADGLTMLADHPDLVAGRNAPTVLTPHAGEFARLAGAPPGDDRVGACRQLADALGATVLLKGNVTVIADPGGPVYLNPAGQSWAATAGSGDVLSGMIGALLASGLPSGEAAAAAAFVHARASAAAAADPGPGDAPTSASRISGHIRAALAAL

SEQ ID NO: 12153 - protein, 480 aa, Mycobacterium tuberculosis H37Rv
MANARSQYRCSECRHVSAKWVGRCLECGRWGTVDEVAVLSAVGGTRRRSVAPASGAVPISAVDAHRTRPCPTGIDELDRVLGGGIVPGSVTLLAGDPGVGKSTLLLEVAHRWAQSGRRALYVSGEESAGQIRLRADRIGCGTEVEEIYLAAQSDVHTVLDQIETVQPALVIVDSVQTMSTSEADGVTGGVTQVRAVTAALTAAAKANEVALILVGHVTKDGAIAGPRSLEHLVDVVLHFEGDRNGALRMVRGVKNRFGAADEVGCFLLHDNGIDGIVDPSNLFLDQRPTPVAGTAITVTLDGKRPLVGEVQALLATPCGGSPRRAVSGIHQARAAMIAAVLEKHARLAIAVNDIYLSTVGGMRLTEPSADLAVAIALASAYANLPLPTTAVMIGEVGLAGDIRRVNGMARRLSEAARQGFTIALVPPSDDPVPPGMHALRASTIVAALQYMVDIADHRGTTLATPPSHSGTGHVPLGRGT

SEQ ID NO: 12154 - protein, 216 aa, Mycobacterium tuberculosis H37Rv
MTPALVVGPAAWHAVHVTQSSSAITPGQTAELYPGDIKSVLLTAEQIQARIAELGEQIGNDYRELSATTGQDLLLITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPNDFVVGYGLDYDERYRDLSYIGTLDPRVYQ

SEQ ID NO: 12155 - protein, 346 aa, Mycobacterium tuberculosis H37Rv
MIEADARRSADTHLLRYPLPAAWCTDVDVELYLKDETTHITGSLKHRLARSLFLYALCNGWINENTTVVEASSGSTAVSEAYFAALLGLPFIAVMPAATSASKIALIESQGGRCHFVQNSSQVYAEAERVAKETGGHYLDQFTNAERATDWRGNNNIAESIYVQMREEKHPTPEWIVVGAGTGGTSATIGRYIRYRRHATRLCVVDPENSAFFPAYSEGRYDIVMPTSSRIEGIGRPRVEPSFLPGVVDRMVAVPDAASIAAARHVSAVLGRRVGPSTGTNLWGAFGLLAEMVKQGRSGSVVTLLADSGDRYADTYFSDEWVSAQGLDPAGPAAALVEFERSCRWT

SEQ ID NO: 12156 - protein, 476 aa, Mycobacterium tuberculosis H37Rv
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPEHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 12157 - protein, 328 aa, Mycobacterium tuberculosis H37Rv
MTIMRAVVAESSDRLVWQEVPDVSAGPGEVLIKVAASGVNRADVLQAAGKYPPPPGVSDIIGLEVSGIVAAVGPGVTEWSAGQEVCALLAGGGYAEYVAVPADQVLPIPPSVNLVDSAALPEVACTVWSNLVMTAHLRPGQLVLIHGGASGIGSHAIQVVRALAARVAITAGSPEKLELCRDLGAQITINYRDEDFVARLKQETDGSGADIILDIMGASYLDRNIDALATDGQLIVIGMQGGVKAELNLGKLLTKRARVIGTTLRARPVSGPHGKAAIAQAVAASVWPMIAANRVRPVIGTRLPIQQAAQAHELMLSGKTFGKILLTV

SEQ ID NO: 12158 - protein, 321 aa, Mycobacterium tuberculosis H37Rv
MVRIAYLGPEGTFTEAALVRMVAAGLVPETGPDALQRMPVESAPAALAAVRDGGADYACVPIENSIDGSVLPTLDSLAIGVRLQVFAETTLDVTFSIVVKPGRNAADVRTLAAFPVAAAQVRQWLAAHLPAADLRPAYSNADAARQVADGLVDAAVTSPLAAARWGLAALADGVVDESNARTRFVLVGRPGPPPARTGADRTSAVLRIDNQPGALVAALAEFGIRGIDLTRIESRPTRTELGTYLFFVDCVGHIDDEAVAEALKAVHRRCADVRYLGSWPTGPAAGAQPPLVDEASRWLARLRAGKPEQTLVRPDDQGAQA

SEQ ID NO: 12159 - protein, 157 aa, Mycobacterium tuberculosis H37Rv
MAISFRPTADLVDDIGPDVRSCDLQFRQFGGRSQFAGPISTVRCFQDNALLKSVLSQPSAGGVLVIDGAGSLHTALVGDVIAELARSTGWTGLIVHGAVRDAAALRGIDIGIKALGTNPRKSTKTGAGERDVEITLGGVTFVPGDIAYSDDDGIIVV

SEQ ID NO: 12160 - protein, 488 aa, Mycobacterium tuberculosis H37Rv
MADPGGFLKYTHRKLPKRRPVPLRLRDWREVYEEFDNESLRQQATRCMDCGIPFCHNGCPLGNLIPEWNDLVRRGRWRDAIERLHATNNFPDFTGRLCPAPCEPACVLGINQDPVTIKQIELEIIDKAFDEGWVQPRPPRKLTGQTVAVVGSGPAGLAAAQQLTRAGHTVTVFEREDRIGGLLRYGIPEFKMEKRHLDRRLDQMRSEGTEFRPGVNVGVDISAEKLRADFDAVVLAGGATAWRELPIPGRELEGVHQAMEFLPWANRVQEGDDVLDEDGQPPITAKGKKVVIIGGGDTGADCLGTVHRQGAIAVHQFEIMPRPPDARAESTPWPTYPLMYRVSAAHEEGGERVFSVNTEAFVGTDGRVSALRAHEVTMLDGKFVKVEGSDFELEADLVLLAMGFVGPERAGLLTDLGVKFTERGNVARGDDFDTSVPGVFVAGDMGRGQSLIVWAIAEGRAAAAAVDRYLMGSSALPAPVKPTAAPLQ

SEQ ID NO: 12161 - protein, 470 aa, Helicobacter pylori J99
MKIKNVLLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDFQAYENAIKKAINLAQKGFLVTFGISIEKPNTEFGYIESPNGLDVKRFIEKPSLEKAIEFQKSGGFYFNSGMFVFQAGVFLDELKKHAPTILKGCERAFESLENTHFFEQKIARLSEKSMQDLEDMSIDIALMQQSHKIKMVELNAKWSDLGNFNALFEEAANGTKENVSLNQTPIFAKESTNNLVFSHKVSALLGVEDLAIIDTKDALLVAHKDKAKDLKALVSEIETHNQELLQTHTKVYRPWGSYEVLHESGCYKVKILEVKPNARLSLQKHFHRSEHWVVISGMASVELDHQSFELQANESTYIPKNTLHRLANYGKIPLIIIEVQVGEYVGEDDIVRVDDDFNRQNQNA

SEQ ID NO: 12162 - protein, 1185 aa, Helicobacter pylori J99
MQKIIEDSLELAKKLQDSISNHLSEQEKAFHFKMQKLLNNPENKVMLIELMDRSFRCLDNKARFEMIEHVLDKYKSREIFSSFEKWLLMGFLSFGKMLPDMSVPFFVNKIRSDTKAMVLDQEESQLRERILKRKNEKIILNVNFIGEEVLGEEEASARFEKYSQALKSNYIQYISIKITTIFSQINILDFEYSKKEIVKRLDALYALALEEEKKQGMPKFINLDMEEFRDLELTVESFMESIAKFDLNAGIVLQAYIPDSYEYLKKLHAFSKERVLKGLKPIKIRFVKGANMESEETIASMKDWALPTFSSKQDTDSNYNKMLDFVLEGDNYKYIHIGAASHNIFEIAYVYTRIHALNDPVVLEHFSFEMLEGMSLQASQELKEMHKLILYAPVCDEAHFNNAIAYLVRRLDENTSSDNFMKAFFNLKVGTSEWKDQEQRFLNSLKGIATLDNTTHRTQDRNAKQTGHTTYPNHSFKNESDTDFILKANREWAKKVRDKMHNAPILELYPEIDGRFEDPNLTPLEVFDRIHHKKIASVHLADKEAILKALEVAKSDKSRFSQKSFTEIHALLSQTAQLFRERRGDLIGISALEVGKTFAETDAEVSEAIDFLEFYPYSLRVLQEQNKKTKFTPKGVGVVIAPWNFPVGISVGTIAAPLAAGNRVIYKPSSLSSVTGYKLCECFWDAGVPRDALIYLPSKGSDISEHLLKDESIKFAILTGGEDTAYKMLKANPTLALSAETGGKNATIVSKMADRDQAIKNVIHSAFSNSGQKCSATSLLVLEKEVYEDENFKKTLIDATLSLSVGDPFDFKNKIGALADKPNEKVIKAIDELKSYENYEIPASFVDDNPYLMKPSIKYGTKKGDFTHQTELFTPILSVMKAKDLDEAIEIVNSTGYGLTSALESLDEREWEYYLERIEAGNIYINKPTTGAIVLRQPFGGVKKSAVGFGRKVGIFNYITQFVNIHQEEEDENALKNPLSEALEGLTQKGYDEHTHELKRAIFMAKSYAYHYKHEFSQAKDYVKIRGEDNLFSYTKVTSVGYRITEKDTLSDMLGVALACLISQIPLTISIENERANKDLTFFLECLKALQANAPIVYESLQKFSEKLNAFNRVRYLKSDLDLLHEQASRLGMVLATAKPCLNGRFELLYYHLERSVSISYHRYGNLGSRVLRQPTCHKSCCAEK

SEQ ID NO: 12163 - protein, 314 aa, Helicobacter pylori J99
MKTFKKGVILDAKSVGLKALEVLKEVADFDFYEVTSPNQIVERSIEAEIMVLNKVVITQEVLSQLPKLKLICITATGTDNVDIKSAKALGIEVKNVSAYSTESVAQHTLACALSLLGRINDYDRYCKSGEYSQSDIFTHISDIKMGLIKGGQWGVIGLGNIGKRVAKLAQAFGAKVVYFSPKDKKEEYERLSLEELLKTSGIISIHAPLNESTRDLIALKELQSLKDGAILINVGRGGIVNEKDLALILETKDLYYASDVFVKEPFEKDHAFLNPKIQNKLLLTPHIAWAYSDSLKTLVEKTKENIQDFLASQK

SEQ ID NO: 12164 - protein, 305 aa, Helicobacter pylori J99
MILTAMQDAIGRTPIFKFTRKDYPIPLKSAIYAKLEHLNPGGSVKDRLGQYLIKEAFRTRKITSTTTIIEPTAGNTGIALALVAIKHHLKTIFVVPKKFSTEKQQIMRALGALVINTPTSEGISGAIKKSKELAESIPDSYLPLQFENPDNPAAYYHTLAPEIVQELGTNLTSFVAGIGSGGTFAGMAKYLKERIPNIRLIGVEPEGSILNGGEPGPHEIEGIGVEFIPPFFANLDIDRFETISDEEGFSYTRKLAKKNGLLVGSSSGAAFAAALKEVQRLPEGSQVLTIFPDMADRYLSKGIYS

SEQ ID NO: 12165 - protein, 426 aa, Helicobacter pylori J99 [sequence omitted]

SEQ ID NO: 12166 - protein, 234 aa, Helicobacter pylori J99
MTKIAMANFKSAMPVFKSHAYLKELEKTLKPQHFDRVFVFPDFLGLLPNAFLHFTLGAQNAYPRDCGAFTGEITSKHLEELKIHTLLIGHSERRVLLKESPSFLKEKFDFFKGKNFKIVYCIGEDLTTREKGFRAVKEFLSEQLENIDLNYSNLIVAYEPIWAIGTKKSASLEDIYLTHGFLKQILNQKTPLLYGGSVNAQNAKEILGIDSVDGLLIGSASLELENFKTIISFL

SEQ ID NO: 12167 - protein, 448 aa, Helicobacter pylori J99
MAKKTSLFECQHCGFTSPKWLGKCVQCNAWESFIELNQTQKEVLNALKKPLPQVQKSVSIAEIEHEEVIKFSSTQSELDIVLGGGIAKGGLYLVGGSPGVGKSTLLLKVASGLAKNQQKVLYVSGEESLSQIKMRATRLDCIEEELYLLNEINWPVIKANMESENYFACVIDSIQTLYSPEISSAPGSISQVREITFELMRLAKTRDIAIFIIGHITKEGSIAGPRVLEHMVDSVLYFEGDPSRELRILRSFKNRFGPTSEIGLFEMKEQGLVSAKEASSLFFSKEEPMEGSAITITLEGSRALILEIQALVSECSFGAPKRLANGFDTNRLNMLIALLEKKLEIPLNRHDVFINVSGGIKISEPACDLAVIASILSSFKNRKIDNKTAFLGEVSLNGRILEAPNLNARLKEMENYGFLKAILPKKPSQKTSIKCYEANVVGKIVEWM

SEQ ID NO: 12168 - protein, 430 aa, Helicobacter pylori J99
MELLHSINDFNEAKQVIAGGVNSPVRAFKSVKGTPPFILKGKGAYLYDVDNNHYIDFVQSWGPLIFGHADEEIEENIINVLKKGTSFGAPTELETTLAKEIISCYEGLDKVRLVNSGTEATMSAIRLARAYSQKDDLIKFEGCYHGHSDSLLVKAGSGCATFGSPSSLGVPNDFSKHTLVARYNDLNSTEECFKKGDVGCVIIEPIAGNMGLVPAQKEFLLGLKALCEKYQAVLILDEVMSGFRASLSGSQEFYGVVPDLVTFGKVIGAGLPLACFGGRAEIMDLLSPIGGVYQAGTLSGNPLAVCAGLSALYKIKRDKTLYTRLNALAVRLTQGLQKSAQNYNIALETLNMGSMFGFFFNENAVRDFDDALKSDTEMFAKFHQKMLFKGVYLACSSFETGFICEPMTEEMIDLAISKADESFDEIINGV

SEQ ID NO: 12169 - protein, 475 aa, Helicobacter pylori J99
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 12170 - protein, 481 aa, Helicobacter pylori J99
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 12171 - protein, 191 aa, Helicobacter pylori J99 [sequence omitted]

SEQ ID NO: 12172 - protein, 375 aa, Helicobacter pylori J99
MTFEPYPFERLRALFKEITPKKKGLDLGIGEPRFETPKFIQDALKSHTHSLNIYPKSAFEESLREAQRGFFKRRFKIELKENELVSTLGSREVLFNFPSFVLFDYPNPTIAYPNPFYQIYEGSAQFARAKSLLMPLVKENDFTPSLNEKELQEVDLVILNSPNNPTGRTLSLEELIAWVKLALKHDFILINDECYSEIYENTPPSSLLEACMLADNGAFKNVLVIHSLSKRSSAPGLRSGFIAGDSSLLEKYKAFRTYLGYTSANAIQKASEVAWLDDRHAEFFRNIYANNLKLARKIFKETLIYPYSFYAYLPVKDGENFAKTLYQNEGITTLPALYLGRNHIGADYVRLALVYDTSLLEKPLEIIEAYRENYA

SEQ ID NO: 12173 - protein, 285 aa, Helicobacter pylori J99
MKIGWIGLGAMGTPMATRLRDAGLEVSVYNRTESKAAPLKEKGVAVYTSPIDLAAKVDLVFTMLSDKAAIDAVLAPKFWEQMSKKIVVNMSTIAPLESLSLEKIAQKHQATYLEAPVSGSVGAAKAGALLILAAGDEEVISKLKPVLAHLGSQTFYLGKVGQGTGAKLSINSLLAQMGVAYSEALLLAKRLGVDAESFLQIIGQSGMNSPLFQAKKGMWLQDNYPAAFSLKLMAKDIRLAKNEAGEAMKLPFLFQAEELYSQAEKSGLGGLDMAAVYHYLEKGEH

SEQ ID NO: 12174 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 12175 - protein, 232 aa, Helicobacter pylori J99
MNKVITDLDKALSGLKDGDTILVGGFGLCGIPEYAIDYIYKKGIKDLIVVSNNCGVDDFGLGILLEKKQIKKIIASYVGENKIFESQMLNGEIEVVLTPQGTLAENLRAGGAGIPAYYTPTGVGTLIAQGKESREFNGKEYILERAITGDYGLIKAYKSDTLGNLVFRKTARNFNPLCAMAAKICVAEVEEIVPAGELDPDEIHLPGIYVQHIYKGEKFEKRIEKTTTRSAK

SEQ ID NO: 12176 - protein, 481 aa, Helicobacter pylori J99
MRILQRALTFEDVLMVPRKSSVLPKDVSLKSRLTKNIGLNIPFISAAMDTVTEHKTAIAMARLGGIGIVHKNMDIQTQVKEITKVKKSESGVINDPIFIHAHRTLADAKVITDNYKISGVPVVDDKGLLIGILTNRDVRFETDLSKKVGDVMTKMPLVTAHVGISLDEASDLMHKHKIEKLPIVDKDNVLKGLITIKDIQKRIEYPEANKDDFGRLRVGAAIGVGQLDRAEMLVKAGVDALVLDSAHGHSANILHTLEEIKKSLVVDVIVGNVVTKEATSDLISAGADAVKVGIGPGSICTTRIVAGVGMPQVSAIDNCVEVASKFDIPVIADGGIRYSGDVAKALALGASSVMIGSLLAGTEESPGDFMIYQGRQYKSYRGMGSIGAMTKGSSDRYFQEGVASEKLVPEGIEGRVPYRGKVSDMIFQLVGGVRSSMGYQGAKNILELYQNAEFVEITSAGLKESHVHGVDITKEAPNYYG

SEQ ID NO: 12177 - protein, 325 aa, Helicobacter pylori J99
MKVFDYEDVQLIPNKCIVNSRSECDTTVILGKHAFKMPIVPANMQTIINESIAEFLAENGYFYIMHRFNGSARIPFVKKMKERQLISSISVGVKKEECLFVEELAKQGLTPDYITIDIAHGHSNSVIEMIQRIKTRLPETFVIAGNVGTPEAVRELENAGADATKVGIGPGKVCITKIKTGFGTGGWQLAALRWCAKAARKPIIADGGIRTHGDIAKSIRFGATMVMIGSLFAGHEESSGETKIENGIAYKEYFGSASEFQKGEKKNIEGKKIWIQHKGSLKNTLIEMHQDLQSSISYAGGRDLEAIRKVDYVIVKNSIFNGDTI

SEQ ID NO: 12178 - protein, 289 aa, Helicobacter pylori J99
MGFADFFKNFKINKLRTTPSKEEQPSHWVKCPKCYALMYYKEVFGKYSVCLKCHYHFRMNATERIEFLCDVGSFEEFDKHLRPNDPLNFVDKESYKQRIKKYEKRTNRPSSVISGEAKINRMPLQIVVFDFSFMGGSLGSVEGEKIVRAINRAVAKKEALLIVSASGGARMQESTYSLMQMAKTSAALNRLSEAKLPFISLLSDPTYGGVSASFAFLGDLIIAEPGAMIGFAGPRVIKQTIGADLPEGFQTAEFLLEHGLIDMIVHRKDLKKTLSDLIAMMTHKTSKIF

SEQ ID NO: 12179 - protein, 491 aa, Helicobacter pylori J99
MAQKTLLIITDGIGYRKDSDHNAFFHAKKPTYDLMFKTLPYSLIDTHGLSVGLPKGQMGNSEVGHMCIGAGRVLYQDLVRISLSLQNDELKNNPAFLNTIQKSHVVHLMGLMSDGGVHSHIEHFIALALECEKSHKKVCLHLITDGRDVAPKSALTYLKQMQNICNENIQIATISGRFYAMDRDNRFERIELAYNSLMGLNHTPLSPSEYIQSQYDKNITDEFIIPACFKNYCGMQDDESFIFINFRNDRAREIVSALGQKEFNSFKRQAFKKLHIATMTPYDNSFPYPVLFPKESVQNTLAEVVSQHNLTQSHIAETEKYAHVTFFINGGVETPFKNENRVLIQSPKVTTYDLKPEMSAKGVTLAVLEQMRLGTDLIIVNFANGDMVGHTGNFEASIKAVEAVDACLGEILSLAKELDYAMLLTSDHGNCERMKDENQNPLTNHTAGSVYCFVLGNGVKSIKNGALNNIASSVLKLMGIKAPATMDEPLF

SEQ ID NO: 12180 - protein, 439 aa, Helicobacter pylori J99
MNFQENLAALDLEYLWHPCSQMQEHQNFPIIPIKKAQGIYLYDFNDNAYMDLISSWWVNLFGHNNAYISQQLKNQIDNLEHVLLASFSHKPIITLSQRLCQLTGMDKCFYADNGSSCIEIALKMSYHAHFLKNQTRRKKLFLSLSNSYHGETLGALSVGDVKLYKDTYTPLLLKNLITPVPKNDSEIENSLNALKRLLDKHGEEICAFIAEPLLQCAGNMHIYSAKYLKQAVLWCKQKNIHIIFDEIATGFGRTGSMFAYEQCGIKPDFLCLSKGISGGYLPLSALLTHNEIYNQFYAPYEENKAFLHSHSYTGNALACACANATLDIFEKENVIEKNKALSEFIFSALQNALKPLIERQVVSDLRHLGMVFAFEVFLQTKERLSLAVFKKALKKGLLLRPLNNTIYLMPPYIITHEEIKKAIAGLVEAIDELKKAENK

SEQ ID NO: 12181 - protein, 350 aa, Helicobacter pylori J99
MRVPSKGFAIFSKDGHFKPHDFSRHAVGPKDVLIDILYAGICHSDIHSAYSEWKEGIYPMVPGHEIAGVIKEVGKEVKKFKVGDVVGVGCFVNSCKTCKPCKEHQEQFCANHKTVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNDHKKQDALNMGVKHFYTDPKQCKEELDFIISTIPTHYDLKDYLKLLTYSGELALVGLPPVEVAPALNVFEFIHLGNRKVYGSLIGGIKETQEMMDFSIKHNIYPEVDLILGKDIDTAYHNLTHGKAKFRYVIDMKKSFD

SEQ ID NO: 12182 - protein, 248 aa, Helicobacter pylori J99
MSAILETKGLKKTYQNHLVLDGINFTLNKGEVAVILGPSGCGKSTFLKCLNGLEKIDEGEILFENTNLNTPSTNWNQMRQKIGMVFQNYELFPHLNVLDNILLAPLKVQKRSKDEVLSQAVELLKRVGLEHKQQAYPKELSGGQKQRVAIVRSLCMRPKIMLFDEVTASLDPEMVKEVLEVILELAKTGMSMVIVTHEMKFAQKIASKIVFFDSGKIAEENSAKEFFNHPKSQRAQKFLETFHFLGSC

SEQ ID NO: 12183 - protein, 435 aa, Helicobacter pylori J99
MGFFKLKEHNTNIATEFRAGLTTFITMIYIVPLNALILSQANMPYEALLSATAIITILSSVFNGLWANTPIAMSVGLGLSAYFSFGLVQGLKLPWQSALGIVALSGAIFVILSFTKFRSWVMRSIPSDLRRAVSAGIGAFIAFIGLKEMHIVVTHKATLVTLGDFSDPHVLLGVVGIILTFALYTLKIKGSFIIAVLITSILAWVLKLAPYPSEFFSMPASISPIAFQLDIKGIFFDASGAFTLVLVPVIITFFVTDLFDSLGTLAGIGHKTDFFNDEEKNKELERTLEADAVASLGSAVVGVSTTTAFIESASGVEEGGRTGLTAVFTGLFFVLTLFCLPLLKAIPSNAIYPVLVVVGVLMFSVLEGVNFKDMAISVSTFLTVVMMPLTFSIADGLAFGFLSYSIIKLVQKDFKALNSGIIILCIISVSVFIFR

SEQ ID NO: 12184 - protein, 157 aa, Helicobacter pylori J99
MLHKKYRPNVAAIIMSPDYPNTCEVFIAERIDIEGAWQFPQGGIDEGETPLEALYRELLEEIGTNEIEILAQYPRWIAYDFPSNMEHKFYSFDGQKQRYFLVRLKHVNNIDLNKHTPEFRSYQFIQLKDLLKKIVPFKRQVYRQVIAYFRKEGYLGC

SEQ ID NO: 12185 - protein, 262 aa, Helicobacter pylori J99
MRYQNMFETLKKHKKMAFIPFVTLGDPNYELSFEIVKTLIISGVSALELGLAFSDPVADGTTIQASHLRALKHASMAKNFQLLKKIRGYNHDIPIGLLAYANLIFSYGVDGFYAQAKECGVDSVLIADMPLIEKELVIKSAQKHQIKQIFIASPNASSKDLEQVATHSQGYIYTLARSGVTGASHTLENDASAIIKTLKTFSSTPALLGFGISKKEHITNAKGMGADGVICGSALVKIIEENLNNEDAMLEKIKGFVGGMIS

SEQ ID NO: 12186 - protein, 369 aa, Helicobacter pylori J99
MELSYYEILEVEKHSNQETIKKSYRKLALKYHPDRNAGDKEAEEKFKLINEAYGVLGDEKKRALYDRYGKKGLNQAGTSQSDFSDFFEDLGSFFEDAFGFGARGSKRQKSSIAPDYLQMIELSFKEAVFGCKKTIKAQYQSVCESCDGTGAKDKALENCKQCNGQGQVFMRQGFMSFAQTCGACQGKGKIIKTPCQACKGKTYILKDEEIDAIIPEGIDDQNRMVLKNKGNEYEKGKRGDLYLEARVKEDEHFKREGCDLFIKAPVFFTTIALGHTIKVPSLRGDELELKIPRNAKDRQAFAFRNEGVKHPESSYRGSLIVELQVIYPKSLNKEQQGLLEKLHASFGYEGEPHKSVLETCVSKIKDWFK

SEQ ID NO: 12187 - protein, 402 aa, Helicobacter pylori J99
MLAKMSFMQNVKNIQEVDVNHKRVLIRVDFNVPLDENLNITDDTRIRESLPTIQFCIDNKAKDIILVSHLGRPKGVEEKLSLKPFLKRLERLLNHEVVFSQNIAQLKQALNENAPTRIFLLENIRFLKGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIANTYAFSLIGGGDTIDAINRAGEKDNMSFISTGGGASLELLEGKILPCFEVLDKRH

SEQ ID NO: 12188 - protein, 464 aa, Helicobacter pylori J99
MLSVYEKGNALDKRVLEEWLLSEDILMENAAMALERAVLQNASLGAKVIILCGSGDNGGDGYTLARRLVGRFKTLVFEMKLAKSPMCQLQKERAKKVGVVIKAWEEKNEDLECDVLVDCVVGSAFKGGLEPFLDFESLSQKARFKIACDIPSGIDSKGRVDKRAFKADTTISMGAIKSCLLSDKAKDYIGELKVGHLGVFNQIYEIPTDTFLLEKSDLKLPLRDRKNAHKGDYGHAHVLLGKHSGAGLLSALSALSFGSGVVSIQALECEITSNNKPLELVFCENFPKKLSAFALGMGLENIPKDFKKWLELAPCVLDAGVFYHKEVLQALEKEVILTPHPKEFLSLLKSVGINISMLELLDNKLEIARDFSQKYPKVVLLLKGANTLIAHQGRVFINNLGSVALAKAGSGDVLAGLIVSLLSQNYTPLDAAINASLAHALAGLEFKNHYALTPLDLIEKIKRL

SEQ ID NO: 12189 - protein, 162 aa, Helicobacter pylori J99
MKPIKTYDIKEEELAKTAYATIKTNKGNITLELFYKDAPQAVSNFVTLAKEGFYNGLNFHRVIAGFVAQGGCPYGTGTGGPEHRIKCEVAHNPNKHQRGSISMAHAGRDTGGSQFFLCFVDLPHLDGEHTVFGKITSAESLSVLDKIKQGDIIESVVFSPSL

SEQ ID NO: 12190 - protein, 261 aa, Helicobacter pylori J99
MNATNNQVLIEVKDLHSAFGSTIIHRGVSFSVHKGEVMAILGGSGSGKSTLLRCMILLNRPTKGEVLLFGEDIWKLKEAEQQKIFNRCGICFQFGALYSSLTVLENVGVMLEQYGAYSKKIVEEISKMWIERVGLPPRAYHLYPYELSGGMTKRVGIARAMATNPEILFLDEPTSGLDPYSAGKFDELIMTLKESLQLTVVMITHDLDSVHDCVDRFIMLKDGLLEFNGDLKDFIKKAQTQGLDEGNLFNSTRGEKFWKGM

SEQ ID NO: 12191 - protein, 365 aa, Helicobacter pylori J99
MHNACNCNSQRVPFKGFAIDGKDGKFHEWEHSRHAMGEYDVVIDTHFSGICHTDIHFAHSDWLPGIYPMVPGHEIAGVVSAVGSKVTKFKVGDHAGVGCMVNSCGECHTCKHEHQEQWCENNKTIYTYSWEDSFHNNEPTYGGYSNNIVVSENFVISIPKEAPLDKAAPLLCAGITVYSPLKFSKVTKGSKVGIAGFGGLGHMALKYAVAMGAQVSVFARNDKKKQMAQKLGATNFYTSVGECKEKFDLIVSSIPTQYDLLAYTKLLKYGGEVAIVGIPPKDPQRNLDFGDLVLFSGNHKVYGSWIGGVKETQEMMDFSVKHGIYPEIELVTGQEIDATWDKLLNGQGNFRYVIDMKKSMENFKK

SEQ ID NO: 12192 - protein, 217 aa, Helicobacter pylori J99
MKVAPSLLSADFMHLAKEIESVSNADFLHVDVMDGHYVPNLTMGPVILENVTQMSQVPLDVHLMVENASFFVELFAPLNPQIISIHAENEKHPHRVLQLIKSSGITPGIVLNPHTHEESIKYLLESVGLVLLMSVNPGFGGQKFLDLVLEKCLKVKELIKRYNPSCLLEVDGGVNDKNIFELQQAGVDVVVSGSYIFESKDRKLAIEGLQNVRQPLA

SEQ ID NO: 12193 - protein, 308 aa, Datura stramonium
MEEANNKESPYISSILPGWFSEISPLWPGEAHSLKVEKILFQGKSDYQNVMVFQSSTYGKVLILDGVIQLTERDECAYQEMITHLPLCSIPNPKKVLVIGGGDGGVLREVSRHSSVEQIDICEIDKMVIDVSKQFFPNVAIGYEDPRVKLHVGDGVAFLKFVAEGTYDAVIVDSSDPIGPAQELFEKPFFESVARALRPGGVVCTQAESIWLHMHIIEDIVANCRQIFKGSVNYAWTTVPTYPSGVIGFMLCSTEGPAVDFKNPINPVDADDSHTKTRGPLKFYNSEIHSASFCLPSFAKRVIESKGK

SEQ ID NO: 12194 - protein, 317 aa, Datura stramonium
MEVANHNNNNNGCTNDKESPCISSVLPGWFSEISPLWPGEAHSLKVEKILFQGKSDYQDVMVFQSTTYGKVLVLDGVIQLTERDECAYQEMITHLPLCSIPNPKKVLVIGGGDGGVLREVSRHSSVEQIDICEIDKMVVEVAKQFFPDVAVGYEDPRVNLHIGDGVAFLKNVPAGTYDAVIVDSSDPIGPAQELFEKPFFETIARALRPGGVVSTQAESIWLHMHIIEEIVANCREIFKGSVNYAWTTVPTYPSGMIGFMLCSTEGPAVDFKNPINPIDDESHGQTIGPLKFYNSEIHQASFCLPSFAKRVIETKGK

SEQ ID NO: 12195 - protein, 315 aa, Buchnera aphidicola str. APS (Acyrthosiphon pisum)
MSKIYQDNSLTIGNTPLVRLNRIGNGNILVKIESRNPSFSVKCRIGANMIWHAEKNNNINKNVKLIEATSGNTGIALAYVAASRNYRLTLTMPETMSIERKKILKSLGAELILTDGRYGMKGAISKANDIISRNPSKYFLLKQFENPANPEIHQITTGPEIWNDTNGNLDILISAVGTGGTITGITRYIKKIKRKKNLISIAVEPSESPVITQFLAGKAIEPGPHKIQGIGPGFIPKNLDLTIIDQVITVSSEEAILTAKELMKKEGILAGISSGAALYAAIKIQQQKKFSDKKIVVILPSSGERYLSTELFSEL

SEQ ID NO: 12196 - protein, 215 aa, Buchnera aphidicola str. APS (Acyrthosiphon pisum)
MLKKHDLLNLDWTKTNGMIPVIIQDYSSSEVLMHGYMNQDALTKTQEDGLVTFYSRTKNCLWTKGEISGNYLKVIEISTDCDNDTLLILVAAQGKTCHLGNSSCFISNKYNINFLFKLEEIIEERKNKFSDNSYTSSLYKSGTSRIAQKVGEEAIETILAAMNKDQIELINEASDLIYHLVVLLHDQDLNFNLVIDNLKKRREKNLNTNSEKLLK

SEQ ID NO: 12197 - protein, 468 aa, Buchnera aphidicola str. APS (Acyrthosiphon pisum)
MSRQQIGVVGMAVMGRNLALNIESKNYSVSIFNRTRSVTEEVFNQNKKKNIVPYFSIKDFIDSLLKPRCILLMVQSGKATDETIKMILPYLEKEDILIDAGNTFYKDTIRRNEKLSKYEINFIGMGVSGGELGALNGPSIMPGGQKEAYKLVLPMLEKISAKFKGEPCVSYIGPNGAGHYVKMVHNGIEYGDMQLISESYFLLKYLLNMSNEELSSTFSKWNKGELNSYLIEITKNIFIEKDEKGKYLIDRILDVAEDKGTGKWISKSALDLREPLSLITESVFARYLSSLKRQRIIASKILQGPKIKTFIKDKNSFIEEVRRALYLGKIISYAQGFSQLKRASEKYHWNLKYGEIAKIFRAGCIIRANFLQKITDEYTQNKNVVNLLLTPYFSKIANEYENSLRNIVMYAIKYGISTPTFSAAISYYDSYRALYLPANLIQAQRDYFGSHTYQRTDQTGYFHTNWSQ

SEQ ID NO: 12198 - protein, 377 aa, Buchnera aphidicola str. APS (Acyrthosiphon pisum)
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCPTCHGKGTIITDPCNLCHGQGRVETYKILSVKIPPGLDTNDRIRLNNEGEAGANGAQSGDLYVQITVKKHPIFEREGNNLYCEVPINFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 12199 - protein, 166 aa, Buchnera aphidicola str. APS (Acyrthosiphon pisum)
MKHTLQVIITEKELDIRVRELGQEITKKYRNSRNKMILIALLRGSFIFISDLCRRIHIEHEIDFMTTSSYGRGMLSSGDVKIIKDLDEDIYNKNVLIVEDIIDSGKTLSKVLDILKLRNPKSLSICTLLDKPECREVNINVDFIGFSILENFFIVGYGIDYAQSYR

SEQ ID NO: 12200 - protein, 349 aa, Buchnera aphidicola str. APS (Acyrthosiphon pisum)
MRIEEDIKLGFKDVLIRPKRSILKSRSQVNLARCFSFKYSASIWSGIPIIAANMDTIGTFEMVKSLSKFNILTAVHKYYSFEEWKNFVCLSSKEILNHVIVSIGTSNIDFLKIKKIFLLSSELKYICIDVANGYSEHIVSFLKLVRDYFPDKIICAGNVVTGEMVEELILSGADIVKVGIGPGSVCTTRVKTGVGYPQLSAIIECADAAHGLNGQIISDGGCTVSGDIAKAFGGGADFVMLGGMLSGHKECSGDIIEEKSKKYMIFYGMSSVSAMQRYEGKIAGYRASEGKTVKIPFRGGVDSTIRDILGGLRSSCTYVGAEKLKELTKRTTFIRVTEQENCIFNAFKE

SEQ ID NO: 12201 - protein, 473 aa, Buchnera aphidicola str. APS (Acyrthosiphon pisum)
MNKKIYTQVVVIGSGPAGYSAAFRCADLGLDTVLIERYDKLGGVCLNVGCIPSKTLLHIAKVIKEAKELHKTGVSFNKPDIDIKKIKNWKQHIVNKLTDGLSSMRKKRKIRIFQGHAIFETDKSLCVTNTEDKFTIFFDNAIIATGSKPIKIPSIPHDDIRIWDSTDALSLKKIPNNFLIIGSGIIGLEMATIYSALGSKVDIIDRFNHFLPVIDEDISSIYKKSINQQFNLMLNTHIDKVEVKKDALIVDMIHENIPKKNILYDAVLVAIGRTPNIDSLGLDRIGLKINNFGFIQVNNQLKTNIPHIYAIGDVAGTPMLAHKGVHEGHIAAEVISGKNHYFEPKVIPSIAYTDPEIAWVGLSEKEAKQENINYEVAIFPWNASGRAIASNCSIGKTKLIFNKQNNKIIGGSIVGSNAGELIGEVGLAIEMGCDAEDIALTIHAHPTLSESIGLSAEVFQGTVTDVLNFKLNK

SEQ ID NO: 12202 - protein, 286 aa, Buchnera aphidicola str. APS (Acyrthosiphon pisum)
MDHKKTWHEKLYCHLGQYFLIEKMLYKKKTPHHQVMIFKNSVFGKIMVIDDIVQTTERDEFIYHEMLTHVPIIAHGSIKSVLIIGGGDGGILREVCRYKMIENITMVEIDVNIIDLCKKYFPNHSNQAYQDSRLNLIIDDGLNFIKRTKEKFDLIISDSTDPIGCGKNLFRSEFYFNCKNHLEENGIFVAQNGVFFLQKNETILTYKNLKKYFYDTRFYQANVPTYYGGVMVFAWGTNNIEYRKNSLEKIQIRIKNTKLDFNYYNAKIHISSFYLPQYILNELNES

SEQ ID NO: 12203 - protein, 269 aa, Buchnera aphidicola str. APS (Acyrthosiphon pisum)
MNRYQETFKRLSCLKEGCFIPFVVLGDPSLETSIKIIETLIKSGADALEIGIPFSDPLADGPTVQKSNLRALSKNNTFFEYFKILKQLRKKNKKLPIGILIYANLVYNQGIDNFYFQCFNSGLDSVLIADVPIEESKIFYNIANKYKINPIFICPPDADADFLYKISLYAQGFIYVLSRPGVTGIKNNTIALPRDFINKIKKYNSVPLLQGFGISNPKQIKEAISSGLSGVICGSAIINIIEKYLNQEKKMIKEIKKFTHLLKLSTKLE

SEQ ID NO: 12204 - protein, 428 aa, Buchnera aphidicola str. APS (Acyrthosiphon pisum)
MSQSDTIFDYKHIWHPYSSMNNPHPCYTVISAKGVYLKLKNRKYMIDGMSSWWAAIHGYNHPVLNKALKKQIRKMSHVMFGGITHPPAISLCRKLISLTPEKLDCVFLSDSGSVAIEVAIKMLIQYWQALGQKRKLFLTIRNGYHGDTFSAMSVSDPKNSFHQIYHNLLPKHLFADAPVSSFYKNWDNEDILSFKKIIEKNSFKIAGVILEPIVQGVGGMNFYHPMYLKQIKILCNHYSIPVIFDEIATGFGRTGKMFAFEHANVVPDILCLGKSITGGTITLAATLTSRHIADTISKGKVGCFMHGPTYMGNPLACAVANANIKILKTNQWKIQVLNIEKQLFKSLMPLINHPYVTDVRVLGAIGVVECSRSINMISIQKFFVENGVWIRPFKKLIYIVPPYIISPHTLKKLTNVISNALNKTELFI

SEQ ID NO: 12205 - protein, 231 aa, Buchnera aphidicola str. APS (Acyrthosiphon pisum)
MKINQVVLIRHGQSEWNTLNKFTGWHDAELDKKGKDEAKFAAILLKKEKFFFDCAHTSLLKRAIHTLQYILDELNQTWLSVKKSWRLNERHYGALEGLNKDEVIEKYGQKQVLLWRRSFDISPPQINIKDKRFPGNDPRYSHLNIHDIPLGESLEKTAKRVIPYWNKIVYPELKNNKKILIVAHGNSLRALIQHLYKIDNKAILDLNIPTAQPIILDFDNEKNPIKWHYLT

SEQ ID NO: 12206 - protein, 255 aa, Buchnera aphidicola str. APS (Acyrthosiphon pisum)
MKKFFITANWKLNGNIKMISSFFKYLKLYSSSYLEKNTVIIAPPTIYLERVCKNISNMNIFLGSQNVDINLNGAFTGETSILMLRDIGVKYVIIGHSERRFLHHETDDIIAKKFHLIKKSNLTPILCVGETEIEKKHNQTEQVIQRQLNLILKNLGTSAFKNIIIAYEPIWAIGTGVSADPEHVQLIHVFIKNYILKYSSINRNDIIIQYGGSINHTNVKKFIEQPDINGLLIGNSSLSAKEFLEIIKIAHEHYS

SEQ ID NO: 12207 - protein, 480 aa, Buchnera aphidicola str. APS (Acyrthosiphon pisum)
MLNRLRRTKIVATLGPSTDINNNLEKIIRSGVNVLRFNFSHGSKDEHKSRANQAREIMTRLNFHIALLGDLQGPKIRISKFIKNNIFLNVGDFFILDANLDQNNGNQERVGIDYKQLPYDLKVGDVLLLDDGRIQLKVIKSTGHEILTKVVIGGILSNNKGINKLGGGLSADALTEKDKKDIILATEINVDYLAISFPRCSNDLKQARKLAKEFGSNAKIIAKIERAEAVLNQNTIEDIILASDAIMIARGDLGVEIGDSELAGIQKKLIRTARQLNRIVITATQMMESMITNPLPTRAEVMDVANAVLDGSDAVMLSAETASGEYPAETVIKMAKICKGAEKVPSINVSRHRIHAKFDDIEEAIAMSAMYVANHLKGITAIITMTESGKTALMTSRITSGLPIFALSKNKETLNLASLYRGVTPIYFNSKNNNFKAANEAIVLLRKRGFLCRGELVIITQGDIMGKIGKTNTSRILKVV

SEQ ID NO: 12208 - protein, 385 aa, Buchnera aphidicola str. APS (Acyrthosiphon pisum)
MPANNSLLIFRDEINNIDKKIVKLLAERKNLVFKIAQSKIENNQAIRDIEREKKMLQKLIFLGKKYNLKSEYITQLFQLIIEESVATQKKLLKKFCNHNKLIPANFSFLGPKGSYSHIAAYKYADLNFQKCITNECSTFEEVVLSVENNQSDYAVLPIENTCSGSINEVFDILKKTNLFIIGEINIFINHNLLTLKKIELNKIKTIYSHPQPFQQCSDFIKKFPEWKIKYTKSTADAMKKIKKYNDVTNAALGSEIGSKIYGLEILMKNLANKENNITRFILLNRNPKKISKNIPTTTTLIFTTGQEAGSLSKVLSILQEKKLIMKKLTSQKIYKNPWEEMFYIDIQVNLSSTLMQDALEKIKKITRFIKILGCYPSEKITPIAP

SEQ ID NO: 12209 - protein, 434 aa, Buchnera aphidicola str. APS (Acyrthosiphon pisum) [sequence omitted]

SEQ ID NO: 12210 - protein, 390 aa, Buchnera aphidicola str. APS (Acyrthosiphon pisum)
MTIRKMTELNITEKRILIRSDLNVPIENGIIQSDARILAALPTIELALQKKAKVIIMSHLGRPKEGYYTKKYSLFPIFEYFKKKFNNTKIYFSNNFLDGIKLNPGEIALLENTRFNKGELNNDEQLSKKYSDLCDIFVMDAFGSAHRMQSSTYGIGKFVKIACAGLLLISEIDALKKALKKPKRPMVAIVGGSKVSTKFNVLNKLSKIADTIIVGGGIANTFLAIDYKIGKSLYEPDFVFEAKKLRDKYNIIVPIDSRVGKNFCKNEQAIIKSPDNIKEDEEIMDFGDESIKKIISIITQSQTIMWNGPVGVFEFPNFRKGTEMIAKTIANSNAFSIAGGGDTLSVIDMFNIKNNISYISTGGGAFLEFIEGKKLPAIQMLEENFKNKSK

SEQ ID NO: 12211 - protein, 215 aa, Buchnera aphidicola str. APS (Acyrthosiphon pisum)
MRIILLGAPGTGKGTQGKFITEKYKIPQISTGDMLRESVVLKNKIGMIIKNIIEEGKLVSDEIVCHLIKNRIKKHDCINGFILDGFPRTIQQALYLSKKNIKIDYVLEFIIPHEYILERISGRRIHIQSGRIYHVKFKPPKIKDKDDLTGQTLITRKDDTKEGIKKRLEEYKKVHDPLVQYYIHEKKRGNIKFFQIDAMLSFSSIRKKLETILKK

SEQ ID NO: 12212 - protein, 241 aa, Buchnera aphidicola str. APS (Acyrthosiphon pisum)
MILYVPKSFSISAPISDIHLQSVLETKNTFHNNNEKLGYILGLSFGNYVNQTFEKQKKIGIELDRNSLLKGIQDAISGNLKLSHQDISSGLKELEKKLKHATKIQLKKNAKENFIQGELYMKNFSKLKGVKKTSSGLLYLLERAGEGEALKDETKITVHYKGTLINGLEFDNSYKRGRPVSLRLKDVILGWKEGLKYIKKGGKIKLVIPPNLAYGTEEVNGIPANSTLIFDIELLDVVNGV

SEQ ID NO: 12213 - protein, 408 aa, Buchnera aphidicola str. APS (Acyrthosiphon pisum)
MISKKTLITRDNFDKLILPIYNPIPFIPIKGKGSRIWDQKGKEYIDFSGGIAVTSLGHCHPILNKTLKNQSKMLWHLSNIFTNEPALRLAKKLLSSSFASRIFFANSGAEANEAAFKLARYYSSKIYNFKKNKIISFYNSFHGRTFFTVSVGGQSKYSNNFGPKPAGIVHASFNDINSVKNLIDHDTCAVVVELIQGEGGVIPANLTFVQALKELCKQYNVLLIFDEIQTGIGRTGKLFYYEYYAITPDILTIAKSLGGGFPISAMLTTNEVASVIAPGIHGTTYGGNPLACAVAESVIDIINTKKVLSGVEKKSKKIISELNIINKRFKLFTEIRGRGLLIGIVLKPNVSRNIHKILNFSLSEGVIFLTAGNNVIRLAPSLIIKELDIIEGMKRFYRALEKYLSRKE

SEQ ID NO: 12214 - protein, 228 aa, Buchnera aphidicola str. APS (Acyrthosiphon pisum)
MNKFFLAPSILSADFARLGEDIKKVIDAGSDLIHFDVMDNHYVPNLSMGPMILESLRNYNITAPIDVHLMVKPVDNLIPQFAKAGATFITFHPEATLHIERTLNLIKENGCKAGLAFNPATPLNFLDYILEKLDLILLMSVNPGFGNQSFLPSTFNKLREVRKIIDANFSDILLEVDGGVKLDNIADIACAGANVFVMGSGLFKYSNYKLVIEKIRKKLEYAHSRSIH

SEQ ID NO: 12215 - protein, 174 aa, Buchnera aphidicola str. APS (Acyrthosiphon pisum)
MNYFTLFDLPRKFNIDKKLLSQNFYKLQLKFHPDLFINDSESKKKIILEKSIQINKGYKTLKNFLNRAIYFLCLNGYEVKKETLLLKNNDFLIRYFSLYEQLDNLKENNFNKKELNNLEQIIQKKIIYCKKKIELEFEKTRYKKVIKIISELLFFEKIKDVLKKEYNIYLSQIN

SEQ ID NO: 12216 - protein, 428 aa, Chlamydophila pneumoniae CWL029
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 12217 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 12218 - protein, 400 aa, Paracoccus sp. 12-A
MAKVVCVLYDDPVDGYPTSYARDSLPVIERYPDGQTLPTPKAIDFVPGSLLGSVSGELGLRNYLEAQGHELVVTSSKDGPDSELEKHLHDAEVVISQPFWPAYLTAERIAKAPKLKLALTAGIGSDHVDLQAAIDRGITVAEVTFCNSISVSEHVVMTALNLVRNYTPSHDWAVKGGWNIADCVTRSYDIEGMHVGTVAAGRIGLAVLRRFKPFGMHLHYTDRHRLPREVELELDLTWHESPKDMFPACDVVTLNCPLHPETEHMVNDETLKLFKRGAYLVNTARGKLCDRDAVARALESGQLAGYGGDVWFPQPAPQDHPWRTMPHNAMTPHISGTSLSAQARYAAGTREILECHFEGRPIRDEYLIVQGGSLAGVGAHSYSKGNATGGSEEAAKFKKA

SEQ ID NO: 12219 - protein, 462 aa, Sulfolobus tokodaii str. 7
MAIVPFKRDPTFYPSPKMAMKAPPEDLAYVACLYTGTGINRADFIAVVDVNPKSETYSKIVHKVELPYINDELHHFGWNACSSALCPNGKPNIERRFLIVPGLRSSRIYIIDTKPNPREPKIIKVIEPEEVKKVSGYSRLHTVHCGPDAIYISALGNEEGEGPGGILMLDHYSFEPLGKWEIDRGDQYLAYDFWWNLPNEVLVSSEWAVPNTIEDGLKLEHLKDRYGNRIHFWDLRKRKRIHSLTLGEENRMALELRPLHDPTKLMGFINMVVSLKDLSSSIWLWFYEDGKWNAEKVIEIPAEPLEGNLPEILKPFKAVPPLVTDIDISLDDKFLYLSLWGIGEVRQYDISNPFKPVLTGKVKLGGIFHRADHPAGHKLTGAPQMLEISRDGRRVYVTNSLYSTWDNQFYPEGLKGWMVKLNANPSGGLEIDKEFFVDFGEARSHQVRLSGGDASSDSYCYP

SEQ ID NO: 12220 - protein, 468 aa, Sulfolobus tokodaii str. 7
MSEVIEIKSPSNLKVIGTVKRMSKDEVRGEIEEAYKGFETISRMPLYKRTAILRKVSEILEREQERLARLLAMEAGKPIKDSRVEVMRASRLFRQAAEEAAIVLEGKNYRVDAYEYPPGNENRIVISTREPIGVVTAILPFNFPINSFAHKVAPAIAVGNSVVVKPSISTPLSAIEMKKILVEAGLPDSAVRIVTGYSNEIGDELITHPLVGLITLTGSTQTGLAIASKAVSLGKRIIMELGGSDPIIVLEDANIDRASSIAVRARYEYAGQNCNAGKRIIVREEIYDKFVKAFKEKVKALKVGDPLDESTDIGPVINQESVEKLNKALEDAQSKGGNVEVLNKGPETGYFFPLSLVTNPSLDMLVLKTEIFGPIAPIVSVKSDEEAINIANSTEYGLQSAIFSNDVNRALKIAKELKFGAIIINDSTRLRWDSLPFGGFKKTGIGREGVRDTMLEMTENKLIAITLL

SEQ ID NO: 12221 - protein, 465 aa, Sulfolobus tokodaii str. 7
MEDKSNLKQTPEWYVARVDRLPAWGLTYALIWAMGFSFFITLYDVINVGFALPYIPFVVTAAQSSLIASLGLWGYVVGAPLFSYIADVIGRRPTLIFTALFTAIGSFGDALSVNYPMLAAFRFITGMGIGADLVLVMTYMAEMSPAHKRGQYVNLAFIGGWAGIGIGPFIAALIVTSIPSIGWRITFLLGAILAVLALAIRAYAPETARFLAMKGKFNEADELVSRMEATAMSRAKVDKLPEPQIKTYSVKKENPFKILAKPKYLKRLITLFLLMFWIYFMDYPFLVLPPTWVKDILGYSGSLFSSAVFYFGLAGIGAFLGSILLRFIIDRFDRRAMTIFGVVVYLIGTGIMAIGGVARSIPVFFAGAFIAELVGVGWYNIYYLLCTENFPTNARATGYAIADGVGHAGGAIGLIALFPLISVLGNIGAWTIPWIPAIAVAIATLFILPKTVKVRLEEVNEATDV

SEQ ID NO: 12222 - protein, 303 aa, Sulfolobus tokodaii str. 7
MIDPKIKKLLESTIQLPIGKASVEEIRSLFKQFSSLTPREEVGKIEDITIPGSETNIKARVYYPKTQGPYGVLVYYHGGGFVLGDIESYDPLCRAITNSCQCVTISVDYRLAPENKFPAAVVDSFDALKWVYNNSEKFNGKYGIAVGGDSAGGNLAAVTAILSKKENIKLKYQVLIYPAVSFDLITKSLYDNGEGFFLTREHIDWFGQQYLRSFADLLDFRFSPILADLNDLPPALIITAEHDPLRDQGEAYANKLLQSGVQVTSVRFNNVIHGFVSFFPFIEQGRDAIGLIGYVLRKVFYGK

SEQ ID NO: 12223 - protein, 400 aa, Sulfolobus tokodaii str. 7
MVLPFKSAEVFSVEVSEKHELFRKAVREFMERDVAPYVEKGEAQREVPKEILEKAKELGLYGITVPEEYGGQGGDTLMSAIAQEEISRIWPSFATRVAAGALFTTPILLFGSEELKKKYVPPVARGEKVAALANTEPSAGSDVAGMQSTAKKINGKYILNGRKIFITNGGIADYYVVTARTSPPDPKARWKGISMFVVEREWKGVKVVSRIDTLGLKASNTAELIFEDVEIPEENVVGEEGNGFKYAMATFDRTRVGVAAQALGVAQAALEKMVSYASQRIAFGEPIVMFELVQEKIAESLTEVNTARLLTYWAATLFDKGLENEAIVAASMAKYYSTEIAEKVVIRAITVHGGYGVATSTGVERLLRDVEVMKIYEGTNDIQKLTIVKETARRLLGIKL

SEQ ID NO: 12224 - protein, 418 aa, Sulfolobus tokodaii str. 7
MSFEKIPWAIKVRAFFVSSGGFLLDGYDLSVISFASTIISKEFSLTSAELGLLVSSSLIGMIPGSIIFGYLADKIGRKKLMGFDLLIFLVFGILTAISNSFASLFLSRLFLGFGIGGDYPISSTIMSELSPSFSRGKYLVGSISMYWIGTAISALFTLLLLPTGEYFWRYVFLVGAIISLPIVLLRVKLIESPRWLVAIGKEKGEKELQVKGATSFMDIFKGRLLVVTFFVTSVWFLFDVASYGIGLYYPYVLEQFAFPSKYEVVLGTLAISVGAIIGYIIAINIVDPLGRRLTLITGLSVMSILLYLGALTHISGSILVPYFMTFVAFEQWAGAVTLFYPTELYPTSVRASGQGFATAISRIGGVLGTFYFPILEHQLGFANVLMLFGSLSLLADIISIVLAKETSRKPLEETSISV

SEQ ID NO: 12225 - protein, 378 aa, Sulfolobus tokodaii str. 7
MVTSDKYYPYDRPPLSKEYLRGKIDRNSIFFEQPNYYTKRENIRIILNTSVEKINVKEKGVELSNGTIIHFDKALIATGGRPRKLKLPGEELEGIHYLRTLDDCDSLKQENGKEAVIIGGGFIGIEVASSLTMLGVKTTVIEVKPYIWNTFVDEKISRLIQNYFEKHGVNFILNEGVKEFIGDKRVSRVITEGGKTLNVDFALIAVGIVPNIEIAQKSGIEVDNGIIANEYLETSAKDIYVAGDVANIYDPSIGKRRRIEHWNNAEYTGKLAAKNMLGKREKYNFLSTIWSDIFDLHIESGGDTTDYDEYIIRGNFSVDNPNFNVIYLKGGVIKGYVAINRDYEELSALNKLIVSKVDVSNKKNELKDEKYDLSKLSL

SEQ ID NO: 12226 - protein, 267 aa, Sulfolobus tokodaii str. 7
MKKFKWFSISPLALGTWGMGGGYWSTDYSNDENDIKAIIKAIELGITAIDTAEMYGNGHAEELVGKAIKNFKREELFIITKVWPNHAKYEDVLKSAIASSKRLGTYIDLYFLHWPSNVPICETIKAFEDLVDKGVIRYFGLSNFKWREIEKASECVKKYEIAAVENHYSLWDRGDEETLEYANKKGLLYLAYTPIEKGRIKNDKFLSEIAKKYNKTPIQIALNWYIRIPSLVPIVKSSNISHLEENVGALGWELSEEDWKKINEHFK

SEQ ID NO: 12227 - protein, 483 aa, Sulfolobus tokodaii str. 7
MKSHIILRLFLHTLTLPNALSSPILSVSKVYQSSRPSSSIRYYTSSLLIISHTVIKNMSVSELLRKNNVEILRFTWVGLDGIIRSKGAYIDEVDNLVKTGIGLTMAMMSFTPMDYISPYGTFGPQDEDVFLTPDLSTLSIFPPSAVVLCYLYKGSSPWMYDPRSTLKKILEKYSEYEFKSSFEIEFYLVKDRKPFDDTKCFDSRAYYNNQIIPEIAKVAGSVGIVPLRVIKEYGPGQYEFDIQHKDAMRSADEVILFKEIARQIASKYNVEANFMPKPFNKMAGSGLHLNFSIWKDGRNLFYDPNDNYGLSDLAYNFIAGIIEHAKALTAIAAPTVNSYKRLVPGSWAPTKITYGYNNKSAMLRIPTPYPGMSMQDRRIEYRVPDATTNPYLLLSAFIEAGIDGIERGLKPPSPVNENAYFRKDIEDVPRNLREALNELKKDTRLIERVGREIVEEFIRVKMAEVEEFESLVTDWEYEVYKYV

SEQ ID NO: 12228 - protein, 387 aa, Sulfolobus tokodaii str. 7
MKFIQLYGDRGLTIVKGEGQYVWDISGTKYLDLHTGIGVAFLGHRNRRVIEYLSRQMENIMTLSTSFSTPIRDEMLKELDPLKPDKMDNIILLNSGTEAVEAALKTARKITGRKKIIAFKNSFHGRTAGSLSVTWNKRYREPFEPLMSPVQFLTYNNIDELKNIDEQTAAVIVEPIQGESGVIPANEDFMKALREQTQKVGALLVVDEVQTGFGRTGKVWAYQHYGIIPDLLTAGKAIGGGFPVSALFLPDWIAEKLEEGDHGSTYGGNPMAMAAVTAASKVLKEDNVVEQASIKGEIFKKILREKLSDLKSVREIRGKGLMIGIEIRFPPAIALKVMQDERVLALKAGSTVIRFLAPYMITQSDMEEASNAARKGIIETENKRAIT

SEQ ID NO: 12229 - protein, 304 aa, Sulfolobus tokodaii str. 7
MLAIRLARGYTKREKILKFDGNYHGAHDYALINAGSAVSEFNVIISSGIPTSIINTVIVCKYNDLDCVEKHLRTEEIAGVIVEPVMGNMGVILPEQDFLNGLRELTKTYNSVLIFDEVITGFRLGLSGAQGYFKVIPDLTTLGKIIGGGLPIGAVTGKKEIMSNLTPEGKVFNAGTFNANPLTMAAGIATIEVLETTNAYDIANKASKEIAEELDNSLSKKNFKYTINRIQSMFQFFIGISKVTNADDARLANKDLYVKIHEKLLKLGVFIPPSQFETIFTSSSHSDEIVNLTIEAIHKVVSEI

SEQ ID NO: 12230 - protein, 202 aa, Sulfolobus tokodaii str. 7
MNYEIEKEIKLVLAVNPSVNSLNDIEVIYSHSHAINEAKETLSKYNFTNFVPVESTSTAALYASKQKYSAAICSEYAANLYNLKIILRDINDSINITRFIVISKKLIEDGDKTMVMFTVPHKPGALYKVLEKFYNNNINLTMIYSRPLKSIPWQYYFYLEFEGNIKDNKVKATLEEIRNITSMLKIKGSFTKLQYQVSNYLS

SEQ ID NO: 12231 - protein, 295 aa, Sulfolobus tokodaii str. 7
MSDSRLLYLNENSRLFAGFNKPTSPFVIIGLPLDITSSFRPGSRFAPSTIREYAQFIEFYSIRTGIDMGEVGFNDVGDVVMHPSDVEENIRRISDVTSYFAEKGKIIIGIGGEHSVTVGTVRGIKPDCVLSIDAHLDLRDEYMGYKYDHACVMRRISEQGVKIMEIATRAVSKEELDYANKNGIAYLTPHQIRLLGVRETAKKIVNNFRDCEKIYVTYDMDGIDPAYAPGVATPEPEGLDPTTVLDIISLIIDKRVVGFDVVEVSPPHDPSGITSVLGARIILETSAQIYKARSL

SEQ ID NO: 12232 - protein, 334 aa, Sulfolobus tokodaii str. 7
MKAIVVPGPKQGYKLEEVPDPKPGKDEVIIRVDRAALCYRDLLQLQGYYPRMKYPVILGHEVVGTIEEVGENIKGFEVGDKVISLLYAPDGTCEYCQIGEEAYCHHRLGYSEELDGFFAEKAKIKVTSLVKVPKGTPDEGAVLVPCVTGMIYRGIRRAGGIRKGELVLVTGASGGVGIHAIQVAKALGAKVIGVTTSEEKAKIIKQYADYVIVGTKFSEEAKKIGDVTLVIDTVGTPTFDESLKSLWMGGRIVQIGNVDPSQIYNLRLGYIILKDLKIVGHASATKKDAEDTLKLTQEGKIKPVIAGTVSLENIDEGYKMIKDKNKVGKVLVKP

SEQ ID NO: 12233 - protein, 377 aa, Sulfolobus tokodaii str. 7
MHGLREGTKVTTEGYDEETGAITTPIYQTTSYIYPIGEKYRYSREVNPTVLKLAEKISELEEAEMGVAFSSGMGAISSTLLTLAKPGSKILIHRDMFGRTYRFFTDFMRNLGVEVDVANPGEILEMVKVKKYDIVYVETISNPLLRVIDIPALSKICKENGSLLITDATFSTPINQKPLVQGADIVLHSASKFIAGHNDVIAGLGAGSKELMTKVDLMRRTLGTSLDPHAAYLVIRGIKTLKIRMDVINSNAQKIAEYLQEHNKIKSVYYPGLKSHPDYETARRILKGYGGVVTFEIKGSMNDALNLITRFKVILPAQTLGGVNSTISHPATMTHRTLTPEERKIIGISDSMLRLSVGIEDVNDLIEDLDKALTSLN

SEQ ID NO: 12234 - protein, 429 aa, Sulfolobus tokodaii str. 7
MRKLLRDEVLEVLKSGRVDYVRVVFADILGNSRGRSLRRIEFEKSLNKGIEYSEALLYLDYKDTPIKQRYGDIFAVPDISTFVLIPYLERTARVLSFLTTQDNSPHPLCTRSLLTRSIDKLAELGYNIKVAFEPTFYLINFKDGKPVPADEARAFSSEGLMEQQNFLRDLIKYLESVNIQVQYINKHYAPGQYEITFSMGEALEEADSLITAREIIRDTARLYHLYSTFMPKPFKEYPSSSMDIYIKLVDTQNKSVGVDTSDPRGLGLSKILYSFLAGILEHISSILAIAAPTINSYKRYREVVTPNVAGIGNERHFIIRIPSTYRDLGVFEFRLADPLANPYLLLSSMIFAGIDGIEKGLDIDVNYEVSTLPTNLKEALYKLDSDTKLKYYLGKELVDTFIELKKKEIEDYEKEITEWEINSYLKSGW

SEQ ID NO: 12235 - protein, 455 aa, Sulfolobus tokodaii str. 7
MKYDVTVIGAGGGGYPGAFRLAKSGYNVLMADPKGELGGNCLYSGCVPSKTVREMAQLIWRTSRVLKQEIKVNFERIQAHKDFVQETRFKQHKRELSEYNSITFYKGVIKIKDPNHVIVKTEDKEIEAETRYIIIASGSEPFKPQFPGSEYCITSDDLYSYKTPLRKLPQDMVIIGGGYIAIETASIFNILGVKTHLLVRGDRVLRGFEDEIVNTLLPILKLDIIYNAPVLEIKKIKEDEFEVIYSSKDGAKKSIRTNLVLLATGRKPVLPEGIENTGIALDKRGYIVVDNAMRTNLPNVFATGDVNGKAPYFHAAVRMSIAAAYNIMANGSPIDYVDYKSIPVTIYSVPSASYVGIMPSEAKRMGIEIMEATYNMEDEVMAQMYDEREGMLKLIFEKGSLRLIGAWMVGVHSQYLINELGQAVLHGLTAKQLASFADQHPSTNEIIAYAARKVL

SEQ ID NO: 12236 - protein, 446 aa, Sulfolobus tokodaii str. 7
MMRLSWTSVLVSGMGVFTDGYNLYSLSLTIYLISNYISLNSVTEGILVAGSYFGAGIAALLFGILSDFKGRKRMYGIDVTLMSIGAIAQAISQNYVELFVSRLLLGMGIGADYVLSPIIVAENAEAKNRGKLMVITFAVLWGLGAVFAAFVDQISSIFLPSSLVWRVVLGVGAIPAISVIMARRKLTETLQFLTKVKPDENELQKIKTNYGLLLGINVDKEKFINRLKASLPFIIVASVLWLLYDIYSSTFAIYGPIVIASNLGLTPITFTYVAQFFAGIPGQLLCIYLIDKVGRKILITIGYAGVALWLVMYSLLLLDPYLFGFKPMKELVGEAALLGFSFYMLNYFFSAIGPASIIGSAMVTPELTYTKVRGTGQAISVAVDRFASATVISLFPSLVNIVGLGAMVGVYAGIAFLSSLITMLFVPETKGKELDEVVKSSLKYGK

SEQ ID NO: 12237 - protein, 478 aa, Sulfolobus tokodaii str. 7
MSKEEETKSSEIIARLDRLPTWAFNYILLGIIGVGELFTFYDIFNINVSFVQTAVTLFHVSPAQAAQLLGPVVLGNLVGYVVGSLVLSPIADRIGRRDMLMITMLIMGLSSLYNAFAPNYINFFIARTLTGIGVGADLAIVNTYISEVAPLAYRSKYVSAIFIFSTVGGFLAIWLGLLFTTPPAPFPQGLPIALGGSGFFAINGWRVMYIIGAVLALIGLALRFRLPESPRWLISKGRVSEAEMIVNLMEEKVTSRGYKLPPLPSLIPIYKASKPVPYSEIFTNSTYLKRFITLVIVWFLAYTTVYSIAAGLTSLLTAQGYSTSEAGMISAIGIIGFILAAVIATLFGDRLERKWWIGIGALVTVIGGMMVALTPNPIIDGLGAIILFIGFNVWVPVAYTWTAESFPTRARTSGFALCDGFGHLGGGLGVVYITSVATTLHSTVELFGLIAGFLVVAAIIAMVTGHYTLGKRLDEISP

SEQ ID NO: 12238 - protein, 419 aa, Sulfolobus tokodaii str. 7
MLSRKIIEESDIYLATSTRDPELFPLVIDHGEGVWIYDVDGNKYLDFTSGIGVNNLGWPSHPEVIKIGIEQMQKLAHAAANDFYNIPQLELAKKLVTYSPGNFQKKVFFSNSGTEAIEASIKVVKNTGRKYIIAFLGGFHGRTFGSISLTASKAVQRSIVGPFMPGVIHVPYPNPYRNPWHINGYENPSELVNRVIEFIEDYIFVNLVPPEEVAGIFFEPIQGEGGYVIPPKNFFAELQKLAKKYGILLVDDEVQMGLGRTGKLFAIENFNTVPDVITLAKALGGGIMPIGATIFRKDLDFKPGMHSNTFGGNALACAIGSKVIDIVKDLLPHVNEIGKIFAEELQGLADDVRGIGLAWGLEYNEKKVRDRIIGESFKRGLLLLPAGRSAIRVIPPLVISEEEAKQGLDILKKVIKVVK

SEQ ID NO: 12239 - protein, 384 aa, Sulfolobus tokodaii str. 7
MKLGFSISAFQYEELNENSDWYLWLTDEINITSKRVIGELPGKNFYLSKFSQIHDIASRLNASFWRLNLSWGRIFKERDKISVEAVTGYRKLLKDLKDRGFKVILCLNHFDLPKWVHDPIIARDSLLTEGPLGWYSEDTINHFISFSSFVKDNFSEYVDLWCTFNEPNIMILFGYLSGIFPPGITSRRAYEKALKNVLTAHREVYNLFHGEKVGIIFNFPYIQGNEKAKEELFTTLKGISFDWIGVNYYTRIVVNEKGQPVDGYGMFCKPNSFSLDNNPCSDYGWEVYPEGLKHVLQGVKKFDKPIIVTENGIADSKDFLRPSFLISHVEAIKESKVNVEAYLYWSLIDNFEWNFGYQMKFGIYTLDLKARPSAYIFKELTSFV

SEQ ID NO: 12240 - protein, 476 aa, Sulfolobus tokodaii str. 7
MSSYEDLLKVLDSRKVTRLYWIITILAAIGGFLFGYDTAVIGTAAEFAPYHYSGFLLGYEIASASLGAAIGAIIAYFYTDRYGRKSLLILDAGIYTAAAVLSALTINGIMLLVMRTIIGIAIGADSAVATAYITEYAPKDKRGSLAIMQQWMITIGILGSYLVGSAILYFLPSLAYVFDWRLILGLAAVPALIGLIFRFMMPESPRWLIYTGQFDKLKRELAKFGISVSDDVLERTRTEIQSEMSIKLDTAAKKALLLVGLWLVFQQITGINVPFYYGPILLSKLHIFSSTTNPVYSAIDGVLESTILAVINVAATYIAFRYIDKIGRRTLGISAYIGMAIFDLIGGISTLFGFDIGLLISFAGFIIFFAYGVGGTGWLIQAEYFDTRIRGRMAAIGALIDWLANFALIEVFPVMLSTVGLGGSMFIFFILDLVALVFVYFFIPETKGMSLEDVVKMFSSVPISKIKNGREIVLSK

SEQ ID NO: 12241 - protein, 217 aa, Sulfolobus tokodaii str. 7
MFGPSFLSENEVEFILWAPYQKKATLRLNEEKYDMEKDEKGYFRITVNAKEGDKYSFIIDKGEIPDPASRYQPDGVHGRSQLISLKYEWKSREVKIKPEDLIIYELHIGTFTQEGTFYSAVEKLDYLVNLGVTAIEIMPVHQFPGKKDWGYDGVYLYAVQNTYGGPYAFMKFIDEAHQRGLAVILDVVYNHVGPEGNYMMFLGPYYDVFRSLLFTKV

SEQ ID NO: 12242 - protein, 456 aa, Sulfolobus tokodaii str. 7
MTEMRLVIVGNGAAAFAALIRANELGVKPVMISHGIIGGTCVNVGCVPSKRMLRIGEVYDYTRKTLGKDVYPDFFKAFEDKQEIVETLRKEKYIDVLSSYDVEYVEGKAHFVSPKEVKVNGKIIEGDKFIIATGSSPQIPDIPGLKELGYWTNVEALSPNRKISSLAVIGGRALALEFAQMYKRLGVDVLILQRSKIIIPNWEPEISIAVQNYLSKEEGIYIVTDVKIKEIKKGDEGGKIIVTDKGEAEVDEILVATGRRPNVDLNLDVAGVKLNEKGGILVNETLQTTNPNIYAAGDVIGDLMLESLAGKEGSVAAENAILNSGKKIDRLSIPQVIFIEPNVARVGLTYLEAQREYSVESRVVKMSSVAKARILREPQGLIKMNVDKNTKKILGVQMFGKYAAEVINEAALAIRLRATIDDIIDTVHVFPTMAESLKLAAMSFYRDVDKMSCCVD

SEQ ID NO: 12243 - protein, 504 aa, Sulfolobus tokodaii str. 7
MKYAKGEELEELKYPKPVTEMIPSYDSIAIDYFGTKITYRELNLMIDSVASQLDINKGDVVIVTMQNIPQFIITEFAVWKKGGIVLPVNPSYTEKELDYIIENSEAKLMIRSCEAINTKKIRTITTNPETFHEIPSELKAKWKIIDCEEELDFKSLHREKVDVSPNDLALLVYTSGTTGRPKGVPITHKNIYASSIIYKHWFKFTEKDKVLGIAPFFHITGQIFHITTPLISGSEIVISYRFDPTLALRHVEEKKTTVTMAVATAYRAILNEYKGEDLSSMRLWSSGGMPMPRTLEIEWREKIGQWIYMAWGLTETTSPATLWPYPYNGELPVDPETGVVSSGIPVYNTEISIAEDGEVLVRGPQVVSGYWKMEKFRDGWLPTGDIGKIIDGWVYIIDRKKDIINASGFKIMPREVEEVIYMHPAVSEVAVVGLPDQYRGETVAAFIKLKDGYTPNEKVEEEIISLCRKNLAPYKVPKIIRFVNEIPKTPSGKIMRRVFRNERI

SEQ ID NO: 12244 - protein, 441 aa, Sulfolobus tokodaii str. 7
MDDDKKIIREHTFKTWSKQSSWEPIIVTSSRGVYFYDSNGKKYLDFSSQFVNVNLGYGNERVINAIKEQLDTLQYINPSFGAVVRAKATKALLEVMPKNLTKFFFSTSGTEANEAAVKVSRLYKKPSYKILARYRSYHGSTEASISLTGDYRRWFVEPNTMPGVVRFPEPYCFRCPLKLKYPECNLACANYVDYIIKQEKNVAAIIVEPITGTNGVIVPPKEYMPLLWKIAKENDVLFIADEVMTGWGRVGEWFAVNLWNIQPDILTTAKGASASYVPIGITAFNKEIGEFFEDHIFAHGHTFEAHPVSLAAIPAVIEEYKRLNLLSHVKVMGEYLGKRLLELKERHKSIGDIRGIGLFWAVELVKDKNNTPFGDYEDKYEGKPTVVDIISKKALEKGVYVYNGPSWLIISPPLIINKEEIDQGIETLDEVIKEADSAFKD

SEQ ID NO: 12245 - protein, 490 aa, Sulfolobus tokodaii str. 7
MLLEEVQKNYGKLKLYIDGQRVESKTEIWGNVYNPAKDEIIAQVPFSTKDETKEAIQSAQEAFEKWRELPITDRLQYLFRIKFKLEEYYETLSRIITQNHGKTIQEARGELRRTIESVESAISVAYTLAKGEHMDQVSQDIDEVSIREPLGVFGIITPFNFPAMVPFWFIPYAIVLGNTVVVKPSEITPVTMDYVIKIFEEVKLPKGVINIVHGAKDVVDEFLENKFIKGVTFVGSTKVGRYVYEKAGLNGKRAIVQAGAKNFIVVMPDADLNKVIPSILSAFFGNAGQRCLAAANLVIVGDVYDEVKRKFVEAARGLKLGYGLDESVDMGPVVTRDAKKRILGYIEKGVEEGAKLILDGRNFRVEDYPNGYFVGPTIFDEVTPEMVIAKEEIFGPVASIIRAKSLDEAIDMINKSNYGNAASIFTTSGYYARKFRREVSAGNIGINVGVAQPMAFFPFGGKKDSFFGVLHGQIDSIDFFTDRKVVIERW

SEQ ID NO: 12246 - protein, 448 aa, Sulfolobus tokodaii str. 7
MTIAGRIERLPWTSFHTKLLALLSLGEFFELYDLFVGGFVVQPISSFYKIPSAEAIYYTIAIFFLGAFVGAIIFTYIGDVMGRRTALILNMFIASVGLLLTPFSPNIYLLGLLRFITGLGVGPEALIVLDVMITEFFPSRIRGRALAIGYTASWTAPIVVAILAYLLIPHSYILQGWQWLYIIGGLGILTIIPFRFLIPESPRWLETKGRIDEAEKIVNMMEEVAIREKGHLSEPLQVEVVTSQKVKISELFSPLYRKRTIMLWIFEFLQTGVYYGFASLAPSVLYAKGFSLVHTLEYSMLIYTSYFISSLASIFIIDSQKFDRKWQVSIVMLLMGIVGLAFGFSTTALEVITTGFLFGFLSNIFSNAFHQYGAELYPTRIRSFADGVQYSLSRLGNYVWLSILPILLYSKGPAFMYAVVFVMALIVTLDVGILGPKASQIELEQLSK

SEQ ID NO: 12247 - protein, 416 aa, Sulfolobus tokodaii str. 7 [sequence omitted]

SEQ ID NO: 12248 - protein, 313 aa, Sulfolobus tokodaii str. 7
MAIYTVKALITDPIDEILIKTLREKGIQVDYMPEISKEELLNIIGNYDIIVVRSRTKVTKDVIEKGKKLKIIARAGIGLDNIDTEEAEKRNIKVVYAPGASTDSAVELTIGLMIAAARKMYTSMALAKSGIFKKIEGLELAGKTIGIVGFGRIGTKVGIIANAMGMKVLAYDILDIREKAEKINAKAVSLEELLKNSDVISLHVTVSKDAKPIIDYPQFELMKDNVIIVNTSRAVAVNGKALLDYIKKGKVYAYATDVFWNEPPKEEWELELLKHERVIVTTHIGAQTKEAQKRVAEMTTQNLLNAMKELGMI

SEQ ID NO: 12249 - protein, 245 aa, Sulfolobus tokodaii str. 7
MRRMLVTYMTLGYPNLESFYQFIEKSVELGTDILEIGLPPKYAKYDGPVIRKSYKAVTSWLKDYITPLKEVRKKVNIPIIILTYLEDYLSNLDNFLTTLHEIGIDGVLFPDLLIDFIDEYEEYVSKIKGKGVKAVLFTGPSLPDNLIIKASRISDIFLYYGVRPTTGIIIPVSVDSLITRVRNLVQNKLVVGFGLNDFNDLRKALSAGADGVAIGTAFIEEIEKNGIQSALHLVKTIRGILDEYS

SEQ ID NO: 12250 - protein, 409 aa, Sulfolobus tokodaii str. 7
MKVYIVEHAIGSFAYDEQGKLIDFVLSSKDLGKVVDSLLDNEKGIPLPTTIELIQKIKPEEVVVENEAEIPNLQQLGVKASYEIHNLGSKIFRESLPKIAIETKFASSENDLYSFLYEVSFEYTRRKLRTAASKRDLLAIQAIRAIDDIDKTINLFSERLREWYSIHFPELNKLVEDHELYASIVSKFGHRDEITNTGLDEIGVNKDLSTKILDASKKSIGADITDVDIRSIKMLSDTILELFRIRSELTDYVESVMKEVAPNVTALVGPTLGARLLSLAGSLEDLAKMPASTIQVLGAEKALFRALRKGGKPPKHGVIFQYPAIHTSPRWQRGKIARALAAKLAIAARIDAFSGRFIGDKLNEELKKRIEEIKTKYAQPPPRKPQEQKRKEEERKGKKGGREKRKGRR

SEQ ID NO: 12251 - protein, 236 aa, Sulfolobus tokodaii str. 7
MKFMSELVKISKTQFENVFQCEFNDGTVRLCTKNLAPGFSVYGERLFKVEGVEYREWNAFRSKLGGAILKGLKQNPIVKGTKVLYLGAASGTTPSHVSDIVELEGKVYGVEFSPRVVREFLLVAQHRPNLFPILADARFPQYYRTLVEDVDVLYVDIAQPDETDIAIYNAKFFLKNGGYMMMAIKARSIDVTKEPTEIYEMEVNKLKENNFDVIQVIQLDPYDKDHAMVLAKYKGK

SEQ ID NO: 12252 - protein, 415 aa, Sulfolobus tokodaii str. 7
MIKVADLNIPVIEDFDINGRKVLLRIDINSPVDRKTGKLLDDSRIKAHAETIRELLDKQNSVVIISHQGRPGDDDFISLEEHSKILSKYVGREIEFVDDVIGPYAREKISKLGKGEAILLENVRIVSEELIEAPPQQQSKTFLVRKLAPLVDFYINDAFATAHRSQPSLVGFPLVKPSAAGRIMEKEVSALSKIFNKEDSPKIFVLGGSKVSDTLKIIEHLAKNRVADRILTGGLVAELFAVAKGINLGKPNMQVLENKGLLSLIPRARKILLSGAPIEIPVDFTVEKPSGELSNDPENNVSGIIKDIGNTTIEIYSSFIKEGKVITLRGPMGVIEDERFRIGTKSLLKASIESPGYVIIGGGHMISMLDKDVEINPNKIHVSTGGGALLLFLAGDKLPALEALHMSWVMQSGKS

SEQ ID NO: 12253 - protein, 300 aa, Sulfolobus tokodaii str. 7
MSSKEVHVFENAIDLMQGMWPTPLLKLNIGNDVWAKLEFYNPFSHSIKDRTALFLFKEAIKQNAKSIVEATSGNTGIALSALSSIFKINFTVFIPSTAPSSFKVLMKILGANVISAGNSTTELLPLVKKLSEFNGYTHLDQFHNEINVLAHYETTAKEIDEQTKVSGIKVKRIIATMGTAGHIVGIAKYFKEKYGDDVEIIGVEPAQGERIPGIKRVTDDKDNKFLKIAKIDRIIEIKFKEAVEGVIDVARNDGILIGLSSGATVSAYKKVIRESKDEGATILIFPDDAFKYVNELEEYV

SEQ ID NO: 12254 - protein, 473 aa, Sulfolobus tokodaii str. 7
MPSLPKTAEEALKFLKDNKIKWVDLQFTDLPGRLHHITVPASEFTEDSFKTGFGKLDGSSIKGFTMIYESDMVLMPIPQTMAVIPWNEGIARVITQVFWGGGKGRFERDPRHIAEEAEKKQSEEGYISYFGPELEFFIFDKVDLDVATPQSGTGYKIHAREAPWARNGGFLIRYKEGYYPAPPVDQLMDIRVEAINILTDYFGFNIEATHHEVATAGQGEIDFRFSTLADTADKVQTLKYVVKNVAAKHGMIATFMPKPMFGDNGTGMHTHFSLWTKDGKNLMYDPNDEYAELSQIGRYIVGGILEHGRALSAIVSPTTNSYRRLIPGYEAPVYLVWSKSNRSAAIRIPSYYRGMEKAKRLEYRPPDPSCNPYLAFAAILMAALDGIKKKIEPGDPVDENVYHMSEERKKQLKIKELPRSLDEALDELESDNEFLKPVFNSSILNTYIDLKRDEAKTMQQYPHPMELYYYLDA

SEQ ID NO: 12255 - protein, 452 aa, Sulfolobus tokodaii str. 7
MHYDVIIIGGGVGGLAAAIRSAELGKKVAIIEKNEIGGECINRACIPSKTLIDTAKIVNKILKSPWIATSAKINYNLMNKFKDDIIEGIKDNLYQVINKHKIDLLSGKGEVKNEGEVIVNGKVYTYENLVIATGSEPLSLADFPLNGKNVVDPWTAMNMTNLPENIIIVGGGVAGVELATLFRALNKNVTIIELMPRLLPVPGIDIEIANEVKKRLEEKGVRIYVNTKSRIIKSDDKVIFQAQTPSSNEEISGDLAVITIGRKPVTDGIDLKAIKVETDQRGYIKVDNRARTSNSKVYAVGDVAGAPLSATKAWRQGIVAGDNIGNRNSQMPKYIPTSIFADLEIGVVGSTLEELKKNGINGREVKVNMKEIPRAWTLNETEGFLKIVIGEDNRILGANMIGENATEVINTITLAMELSLKIDDLYKVQFSHPTVSEIITEVVQRAIVGEIY

SEQ ID NO: 12256 - protein, 237 aa, Sulfolobus tokodaii str. 7
MNCIELRNVVKKYGKVTALNNVSFTIECGEKVALLGPNGAGKSTTLKLIVGLLRPDNGEVLVKGLDPFSTKARGIIGYLPEDASPYLMLTVRENLEYIASLRGVNNVKDKVDKLLDFLALRQYEKNRVMSLSRGNRQKLALALALIHDPEILLLDEPLNYLDIPTQERVISLLNSMTNATMLVSTHIMSIARRLASKVIVLSNGQVVWQGNISDLKKFGEENEPIESIVARLMESVK

SEQ ID NO: 12257 - protein, 438 aa, Sulfolobus tokodaii str. 7
MFRKTKIIATLGPSSENHIDELVKYVDVIRLNFAHGDKEQHEKYFNLVKNRVPILVDLPGPKLRIGDLGKNMILLKPGDTIEFGTQIPVDDILFFKLIRKGSEVLISDGRIRVKIIEAGNNYAKGLVEEGGILTSRKGINIPDSEIPVGLTDRDLELLKYALEMGATFIGLSFVTSPEEIRKAKEIVKDQAWIIAKIEKKSALKKLKEIIREADGVMVARGDLGVEVGLANLPQTQRRIVRLTRLYGKPVILATQVLESMVTSPIPTRAEVIDVANSIIQGVDAIMLSDETAMGQYPIDAVRTLHELILSVERSFKPRPPPPLKNIDDAIAYSAVSASNLASSSGIVVYTRTGASALRISRLRPVVPIIVLTQNQRVYERLKLCYGIYSFISEELNSLDNIVEKSKNIARQVGLKNTIIIIAGGIEEGSTRFLKVEEI

SEQ ID NO: 12258 - protein, 437 aa, Sulfolobus tokodaii str. 7
MEYDVIIIGGGTAGYTAGVILGRRGKKIAVVEKEKFGGTCVNYGCVPSIFLSDISFLYSRLSEIGNYKGIEINLKLNNFFSKREEIIDYLSTAGKRLIENASGETIEGEGIIRDNHTVEVNGRLLTTKEIIIATGSKPKPPRIEGIENAISEDQVVRLNTIPSSMVIIGGGVAGTEIAQIFAKLGTKVTLLTRSKILKELHEETRKLMIDSLEFDGIDIIENSKIEKIYGEKVYTNKGVFDGEIVVYATGREPNYPKGFEKLNVEIGKEGIIVNERMQTNIKNIYAIGDIVNKEKKVAHVAYMEAIIASLNVLGTCEYMDYTGTPQVIYTDPQIGIAGEKDKAVKFLKFPYNADTRAIIKGLREGFALIGIDKNGTIVYSEIIGDNAEELINIMALAIRKRVTIRDLAFTIFIHPSLSEILVNAARGEFDLDVDLYK

SEQ ID NO: 12259 - protein, 361 aa, Sulfolobus tokodaii str. 7
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 12260 - protein, 499 aa, Sulfolobus tokodaii str. 7
MIDTKRMRAIEINSEALGIPTLLLMENAGRSVKDEILARIKPNNAVIFVGHGGKGGDGLVTARHLASEGVKVKVIVLGENKHKDAVFNYNAILDMDYSIEINEIKDLEELKPVEADVLVDAMLGTGFRGKPREPFATAIRVFNESKGFKVSIDLPSGIDADTGEAPGEYVKPDLVVTFHDMKKGLLRYNFNVVVKKIGIPPEAEIYVGPGDVVVSIKKRDYKSKKGDNGRVLVIGGSYTFTGAPTLSALAALRTGADLVYVASCEETAKIIAGYSPDLIAIKLSGKNISPNNLEELKPWIDRADSVIIGPGMGLSEETIEASKMIVNYLMEKNKPAVIDADALKAISGYKLYPNAVITPHAGEFKIFFKEETEKDIRKRIAQVVEKAKECNCVVLLKGYVDIVSDGKEFRLNKTGNPGMTVGGTGDTLTGIVGTFLAQKLSPFDAAAIGVFVNSLSGTLAYSELGPHITPSDILNKIPVVLNDPIESFKKKIYKRVVNS

SEQ ID NO: 12261 - protein, 332 aa, Sulfolobus tokodaii str. 7
MIMMKALIFEKSGIENLKISDVKEPTLGPHDVLVKVKMAGVNPIDYFVVNFIPVTPMPHIPGAEIYGEVAKVGDHVKSVNIGDKVVVYNRVFDGKCDMCLQGMEQLCRNGGIISIITNGGFSEYFSVSEHNLVKVEGINDEIAASLPVAALTAYHALSTVQVFGKTVVVFGASGNTGQFAVQFAKMMGGYVIAVSNKNWVKEFGADEVVSYDKVEEKVKELTNGRMADIVINSVGSSVWDKSLSVLGLNGKLLFFGGITGSNVSLDLGAIYGKHASLIGTTGGNRKELVELASMAKKLKVKVWKVRKLEDGKEALQDLFNKNRDGRILIKIE

SEQ ID NO: 12262 - protein, 329 aa, Sulfolobus tokodaii str. 7
MSLIPLIYSDVYLLHKPKHTHSENPDRIKRALEELKNYPIISPQKVSEEEVKLIHDEDYINLVKSSSEKESMIDADTYTSKETFNVALYALGGALKAFETNGFGLLRPPGHHAGRFGKAFGAPTLGFCIFNNIAFPIRKYALTKVLIIDFDVHYGNGTQDIFWNDPEVVHIDIHQDPRTIYPGTGFPDMIGGKDAEGTKINLLIPPLGGDDLYEELIPIIQSVIDDFKPKIIAYSAGFDAFEGDGLASVRATEWTYYNMGLLSNRFERKYAVLEGGYGVGLIRGLKAFIYGLQGEKKVYSKNTSSDAVKSRFRNYLSEEKMILREFWKI

SEQ ID NO: 12263 - protein, 473 aa, Sulfolobus tokodaii str. 7
MSDKPTKEQIYKKVAELTARIDRLPTMVLPISVILALAFGYFIALYDVIDIGIAFSGTSLPYTGLTSTQASIVVSMGLAGYIPGAIILGYFADKYGRKPMLMFTALLTAIGSLGNALSFNFPMFIVFRFITGMGIGGDLILVPTYIVEMVPAVKRGQYFNLVYIAGWAGLGLGPFLASVIDLLNPAIGWRVIFLIGATLAFIVLVIRSHASETVRILALKGKLDEAEKIVAEMEEKAIQKTGIQLPPYNPLNYKVEEKNPFTIFKNKKYAIRIISVMLSIFFFYFGEYPYLTQFLLWAGGLSNLTKAQINELTFLYGLAGVATFLGAIALRFIVEKVRRAILTTLAYFVGMLLGVLIATIGTINYNVPLAFGGMLLTNFIGVGWSNQLNYLNGTENVPTYARATSFAFSDGAAHLGAAISTAIILPIISSLGALPTWVLFQVPMVIMGIVLIFVLPNTIGQSLEKINEAEAGV

SEQ ID NO: 12264 - protein, 311 aa, Sulfolobus tokodaii str. 7
MAKLITLGEILIEFNALSPGPLRHVSYFEKHVAGSEANYCVAFIKQGNECGIIAKVGDDEFGYNAIEWLRGQGVDVSHMKIDPSAPTGIFFIQRHYPVPLKSESIYYRKGSAGSKLSPEDVDEEYVKSADLVHSSGITLAISSTAKEAVYKAFEIASNRSFDTNIRLKLWSAEEAKREILKLLSKFHLKFLITDTDDSKIILGESDPDKAAKAFSDYAEIIVMKLGPKGAIVYYDGKKYYSSGYQVPVEDVTGAGDALGGTFLSLYYKGFEMEKALDYAIVASTLNVMIRGDQENLPTTKDIETFLREMKK

SEQ ID NO: 12265 - protein, 310 aa, Sulfolobus tokodaii str. 7
MGSNFINYDFYIHSIIYLLMYDVKKFKYFTVSSIAFGTWRIGGGYWYASHDRDNEWVSAIKRAIELGITLIDTAEMYGNGHAEELVGQAIKSFDREQLFIVSKVWPSRADYDNVLKSANNSSKRLGTYIDLYLLHAPSRVPICQTMKAFEKLVDDGIIRFFGLSNFDVKGIENARQCLSKYELVAIQNHYSLLYRKDEESVLGYAERNGLMYMAYTPLENGILSKNEFLANIGRKYNKTATQVALNWYISHNNLVPIVKASKINHVEENAGVMGWRLSEEDWKAIDTHFRERNYLLDKFISTLKSMRPWK

SEQ ID NO: 12266 - protein, 473 aa, Sulfolobus tokodaii str. 7
MMEDKKSDLQKPELKRDVLGTWLVASYGIAANAPIAVATLYFVGLAGLVGGAMPLTVLLSYLIYATTLVVIYEWSKEIAASYGYVAMIKKGLNSSLAAFTVGYGYIYQYLIAGAAGFGILGLASFIYLISPSIQVTMPWLWALIVVIVTAEITLIMWLGVKPGGILNLIIGLISIGFLIITSLYLIVIAGPKNTIYPFTALPVNNNWASVLTAMIFGVTTFGGATTPIGVAEEAKIPKKTLPKALLITFLLLGIGLILNSYAQTIVYGINNMFNYANLPDPMIIIYNKYFNPVIVGLLIFLVAFMFNSSALAFATSGSRMIFGMARDGILYPEVFSRTNRYGVPGNAIILTGIITGVVSLISGYILGPLEASIFLITFGSFYVALGHLFAAIGLITHKIKLRKADIVKHIVVPLISIGLYLAVIYFGTYPAPAFPLNIAVYTAWGVLLLHIIGYYILRTRNPEKIRHFGDYSL

SEQ ID NO: 12267 - protein, 459 aa, Sulfolobus tokodaii str. 7
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 12268 - protein, 330 aa, Sulfolobus tokodaii str. 7
MKALVFDKSGIENLKYTDYEDPKIGPNEVLIRVRYAGVNPVDYYTVTRLNVKPLPHIPGVEFAGEVEKVGERVTKVKPGDRVTIYGRIFDGTCDMCMIGYETLCRNGGRIGVDANGGWAEYIAVEEKYVFKLPSEFSWELGSSMTVSALTAYHALKEANLKPGEVLVVFGASGNTGMFAVQLGKKFGAKVIAVSRKSWLKDFGADLVVGYDEVEEKVKEFTNGKMADVVIDSLGGKLWNKGFSVVGVKGRIVTFGTLLGAEVSLNLSELYSKHISILGVNRGNRKDFVELLELCKDCKVKTHKTYKLEEGKEALQELFNEKRDGRIFLST

SEQ ID NO: 12269 - protein, 355 aa, Hordeum vulgare subsp. vulgare
SARGALKLEEFGISGSDAENICYLRNLEDADKLVNAMSSCSGGNAVVIGGGYIGMECAAALVTNKIKVTMVFPEKHCMGRLFTEKLAEYYESYYTSKGVTFTKGTVLTSFEKDSTGKVTSVILKDGNHLPADMVVVGIGIRANTSLFEGQLLMEKGGIKVNGQMQTSDSSVYAVGDVAAFPIKLFDGDVRRLEHVDSARRTARHAVAAILEPSKTRDVDYLPFFYSRVFTLSWQFYGDNVGEVIHYGDFTSNSPRFGAYWVSKGQITGAFLEGGNRDDYEALSVVVRRKTKASDMSELERQGLAFAIQESKKEVPDSGVTLGEKPTFVWYATAGVVAAVSISAFGYWYGRKRRRW

SEQ ID NO: 12270 - protein, 154 aa, Beta vulgaris
MESNGKGVSIDGVVLPFEAGEIDFGEPGTNGQHSFYQLIHQGRVIPCDFIGIAKSQQPVYLKGEVVSNHDELMSNFFAQPDALAYGKTQEELQKENVSPDLVPHKTFSGNRPSISLLLPSLTAYNVGQLLAIYEHRIAVEGFIWGINSFDQWGV

SEQ ID NO: 12271 - protein, 120 aa, Yarrowia lipolytica
WSYGAMFASMIFKKEPFFHGTSNTDQLVKIARVLGTEKLWDYLEKYNIELGAEYDDIGTYPARPWSKFVNVDNEAYISQEAIHLLDNLLRYDHQERLTAKEAMAHDYFKPVRVREEGEQE

SEQ ID NO: 12272 - protein, 239 aa, Thermotoga maritima MSB8
MKGFIAYIPAGFPDLETTRKILIALNELGITGVEIGVPFSDPVADGPVIQLAHSVALRNGVTIKKILEMLSEISVDYDLYLMSYLNPIVNYPEGKEKLLDELKKLGVKGLIIPDLPLREVKNVDIAYPIVPFVAPNTKDEEIDLINSVQAPFVYYISRYGVTGEREDLPFADHIKRVKERIKLPLFVGFGISRHEQVKKVWEIADGVIVGSALVRIMEENPKDEIPRKVVEKVKELLGK

SEQ ID NO: 12273 - protein, 353 aa, Thermotoga maritima MSB8
MRHKIRLIDFILLRFIEERMKVARDVAKEKKKTDSPIVIRDIEEQKIKEILDRTDLNPVRMRRIFEEIMKLAKEEEYRLLGISKTVAVLGPMGSFSDEMAMKLIGSRIPLKYCSTTDEIIEMVEKGEVDYGIVPIENSTYGTVIPVLDALLNHEVEVFGEAKLEIHHCLVAKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLERVTAFYKIIGVFDEVEELDVFK

SEQ ID NO: 12274 - protein, 368 aa, Thermotoga maritima MSB8
MTVLIVEDDDITREAMGQYLKLSGFNVIEAENGEKAVELSENVDVALVDVMLPGMSGIEVVNKIKAKNPSCVVFVVTAYDDTEIVKKCVEAGADDFIKKPVNLELLRLKITHALRNRVFHMYRNSYLKSLKKKLFLLEKTAEEFFTEYEDFLFEVLEILNMLSEYRDMETHRHTERVGWLSGRIAEEMGMSEVFVTEIQFAAPLHDIGKIGIPDRILLKPGILTPEEFEIMKQHTTIGFRILSRSNSPILQLGAEIALTHHERWDGSGYPRGLKEREIPISGLIVAVADSFDAMVSRRPYKNPKPLEEAFREIESLSGKLYSPEVVEAFLKLEKEITDVYRREKDEDTSHNGGRSHQSSPGEGVEGIR

SEQ ID NO: 12275 - protein, 440 aa, Thermotoga maritima MSB8
MKKFVCSNCGYVSPKWFGRCPQCGEYDTAEEVQRRKNREGSPSLFLNLEDAGEISLERLSTGFSELDRAFRGGIVPGQVILLSGEPGIGKSTIALQIAERFAERGLVVYVSGEESPQQLKLRADRLLLKRKKDILLTLENDIDEIISSLQNKRVSFMVVDSIQTVFSSDLGSSPGSISQVKNVTMKTIDFAKRRGVPVLLVGHVTKEGEIAGPKLVEHMVDTVAYFEGDRRTGLRLLKITKNRFGPSDEVAVFELKENGFVQVENPSFTEGDADLPGNVLTCVFEGTKPFVVQIQALVSKNRTFSPKRVCKGVDVNRVMLLIAVISKYLKLPIETHDVYVNVVGGLRVTDPAADLAIALSIVSSYLEVSLHNTAAVGEIGLDGRVRKVYNINRRLNSLKSSGRIIVPPIEEEQKGVFEVRDLKEAVSIIGGEILGTPGAD

SEQ ID NO: 12276 - protein, 171 aa, Thermotoga maritima MSB8
MMIKVLIDEETLKKRIKELAREIEEYYLGKTDTIHAVCILKGSIHFFSDLMLNIRKLNVKYSFIHVSSYQGTSSTGKIRVKSWIDESIHDEYVLLVEDIVDTGLTLQHIVRYLKKYNPRDFRIVSLIEKTVHDHGIPLDFVGFRVDDKFLVGYGLDIDEKYRNLPYIGYVE

SEQ ID NO: 12277 - protein, 466 aa, Thermotoga maritima MSB8
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 12278 - protein, 312 aa, Thermotoga maritima MSB8
MRIDLSLKPTPVQFLKRLSEKYGFNIYVKRDDLTELVGSGNKIRKLEYLLWEALKKGATTVFTCGGLQSNHARATAYVSRRYGLKPVLFLRKGEKVLNGNLLLDILLGAEIVEVSPEEYERIDEIFDVHKKMREKKGEKVYVIPEGGSNSLGAFGYFNAVLEMKDQLNLESFDAIVCAVGSGGTIAGLSAGISFLEYHVPVVGVNVTTKNSDYFVGKVKRIISGMEEYGLRVNETVFEVVDDYRGPGYAIPSSEDVEILKEVASIEGIILDPVYTAKAFRGMIEMFRNSEKNVLFIHTGGIFGLFAQSRRLV

SEQ ID NO: 12279 - protein, 315 aa, Thermotoga maritima MSB8
MNVLCTGEILIDFISEDKGKNLSQSELFRKKAGGSPLNVAVALKRLGREVSFLGKLGGDQFSEFLLEVMKKEGIDTTHIIFDSSCKTTLAFVARDAQGNPDFVFFREKPADTNLRPEEVNIDPAQFSFLHIGSYSLAVEPSRSAYLKVMETFLEEGKPVSYDPNVRPSLIEDRNTFVKDFLEISSKVDIVKLSDKDLEYIFQEDLETAVDKIPIKENGLLFVTMGERGCLVKFKGEKRMVPSFKVKPVDATGCGDSFTAAVIHKYLEKTPETIEDAVEIGKFANAVAAIVITRVGGVDAMPVLDEVEMFLSNQER

SEQ ID NO: 12280 - protein, 441 aa, Thermotoga maritima MSB8
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIGKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 12281 - protein, 443 aa, Thermotoga maritima MSB8
MRYDVVVVGGGPAGLVAAFTTKRFFGDKKILVVKKTEKEMVPCGIPYIFHTLGSVENDYMGIEDRFKGAGIDLLIDEVVDGNPDEKKLFTKSGKEISYDKLIIATGSSPNIPKIPGVDLKGVFTVPKEADYLKLLHEKVKDANDVVIIGGGFIGVEVADEIKKSGKNVTLVEIMDSLLPVSFDPDFGELARKELESDNVKVLTGRKVTEILGTEKVEGVKLDSGETIPADVVVLATGYKPNSELARKLGLKVTELGFIETDEYMRTSKPDIFAAGDCVQHKDFLTGKPSRLMLASAAVFDARIAASNLYGLKVIRTNKGSLNAYSTVIGSKAFGSVGITERIAKEEGFEVVVGKAEAPDRHPGKFEDTSKLVVKLIFSEDSKILLGAQVCGGKSVGEIVNLISLGIQKGITANDLFTMQIGTHPLLTSAPTVYPLAKAAEMVL

SEQ ID NO: 12282 - protein, 449 aa, Thermotoga maritima MSB8
MYDAVIIGGGPGGYVCAIKLAQLGKKVALVEKDALGGTCTNRGCIPTKAMLTVSHLMDEMKEKASKYGLKVSGVEYDVAAIMKHVQKSVMMSRKGIEYLLKKNGVEVFKGTAVVENKNTVVVQETGEKLEAKNLVLAHGSVPSVFSPFDIDGVWTSDDVFNLKEFPKSLVIVGGGVIGVEFATFFGSFGVDVTIVEIAEHILPYEDSDVAEEVKKALKRKGVKILEKTKISSLSKVDDGFEVALENGETLKAEKVLLAAGRKPNIPEDVKALGVKIEKGVVTDSRMRTNVENVYAIGDIRSGIMLAHVAMYEGIVAAKNIAGEEEEMDYSAVPSIIFSSPEVASVGVREKDVNPEEVVISKFPVSANGRARTMLENIGFAKVIADKKDGTVLGMSIVSPSATDMIMEGVIAVKFRMKAEDLEKAIHPHPTLTETILGALEGVSGKPIHL

SEQ ID NO: 12283 - protein, 425 aa, Thermotoga maritima MSB8
MRYVIVGSGPAGLNAIEAIREVDKEGEILLITAEKYVGYSRPLITYLLGRKVTEEKMYYRTEDYLREMRVDIKPATRVEKVIPEEKTVVTDSGEEIRYDKLLIATGGKPFVPNIEGLTGKKGVFTFTTWEDEEKVEKYIEENDVKEAVVLGGGLIGLKTTEALMELGVKVTIVELADRILSVTFDRKASEIITEALKKEGCSVITNDTVVKVNGDDTVSSVVLKSGKEIPTKLLVIAIGVKPNVEFLKDSGIEINRGIVVNEKMETNVEGVYAAGDCTEFYDLIDGQRKTIAIWPVAVAQGRVAGYNMAGKNVRYPGGIPMNSVELAGIPTISVGHSNVEDGGYEILTFEEGNTYKKMVLKDNRLVGAILVNDIDRAGIYTGLILQKLDVSSFKDRLLDENFGLVYLPKEFRKKMLEGEIKIWLE

SEQ ID NO: 12284 - protein, 435 aa, Thermotoga maritima MSB8
MRKRVFSLLLVLAFLSVGFAQDGVTDVGWSLDMVWILISAALVFFMQAGFAMVESGFTRAKNTVNVLMKNLMDFAIGSVVFFIFGYWIMFGKHPLTFDPSTKEGLWDFAMWMFQMAFAGTAATIVSGAMAERTKFPAYLAYTGFITGIIYSVVGRWIWGGGWLAQKGFIDFAGSTVVHSVGGWAAMIGASLLGPRFGKYDSQGNPKPIPGHNIPLAALGTFILWFGWFGFNGGSTLAGTNGAIGMIILNTNLAAATGALAAMVTVWAKYGKPDASMTMNGALAGLVAITAPCAVVSPVSSLIIGAIGGVIVVFAVEFFDKVLKIDDPVGAISVHGVNGAWGTLAVGLFAESKYALASGMGDVNGLFFGGGVHQLGVQFLGVVSVFAWTVVTSFLVFWFIKKTIGLRVDRDIELKGLDIEEHGMEGYADFEIFTTR

SEQ ID NO: 12285 - protein, 359 aa, Thermotoga maritima MSB8
MPSIRVVNLKKYFGKVKAVDGVSFEVKDGEFVALLGPSGCGKTTTLLMLAGIYKPTSGEIYFDDVLVNDIPPKYREVGMVFQNYALYPHMTVFENIAFPLRARRISKDEVEKRVVEIARKLLIDNLLDRKPTQLSGGQQQRVALARALVKQPKVLLFDEPLSNLDANLRMIMRAEIKHLQQELGITSVYVTHDQAEAMTMASRIAVFNQGKLVQYGTPDEVYDSPKNMFVASFIGNPPTNFLRDFSVSVENKQTILKRDDVIIKLPEPVDVKLKEVVVGIRPEHCRISRERVENSIPGVVYVVEPLGRDIIVNVKTEKGEIIKVFGDTGKAPQPGENVFLVPDLRKIHLFNPETEETIL

SEQ ID NO: 12286 - protein, 367 aa, Thermotoga maritima MSB8
MLMRFSRVVSLVLLLVFTAVLTGAVKASLNDKPVGFASVPTADLPEGTVGGLGGEIVFVRTAEELEKYTTAEGKYVIVVDGTIVFEPKREIKVLSDKTIVGINDAKIVGGGLVIKDAQNVIIRNIHFEGFYMEDDPRGKKYDFDYINVENSHHIWIDHCTFVNGNDGAVDIKKYSNYITVSWCKFVDHDKVSLVGSSDKEDPEQAGQAYKVTYHHNYFKNCIQRMPRIRFGMAHVFNNFYSMGLRTGVSGNVFPIYGVASAMGAKVHVEGNYFMGYGAVMAEAGIAFLPTRIMGPVEGYLTLGEGDAKNEFYYCKEPEVRPVEEGKPALDPREYYDYTLDPVQDVPKIVVDGAGAGKLVFEELNTAQ

SEQ ID NO: 12287 - protein, 469 aa, Thermotoga maritima MSB8
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALHGPSLMPGGSREAYNLVEEILLEIAAKTEDGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVSLSEVLRIWKGGCIIRAKLIDTLRRYISNENAYLLENEEVMNLLKGKIDSLKNILKASIENEIPVPVLSSSYNYFMSLTEERLPANLIQAQRDFFGAHTFERVDREGVFHINWEEGEIG

SEQ ID NO: 12288 - protein, 242 aa, Thermotoga maritima MSB8
MTVLKIEDLHKYFGKLYVLRGIDLEVKKGEVISIIGPSGSGKSTLLRCINLLEEYQRGKIYFKGELITHRNINRIRSSIGMVFQQFNLFPHLSVLNNLTLAPMKVKNMQKDEAVEKAKKLLERVGLIEKINEKPGNLSGGQQQRVAIARALMMDPELMLFDEPTSALDPELVKEVLDVIKDLAQSGMTMLIVTHEMRFARDVSDRVVFMDEGRIVEMGPPEKIFSNPENERTREFLEHFLSV

SEQ ID NO: 12289 - protein, 461 aa, Thermotoga maritima MSB8
MRKSKQSTGSRDPLKFFISEVSCVFRLKENGTNVKTEIFAGIATFLTMAYIVFVNPSILVQAVGVDASSPLYQQFFGAFMVATILGSATATLVMAFFANYPFALAPGMGLNAYFTYTVCLGMGIDWRVALAAVFVEGLIFIGLTLVGFRKFVAGIIPESIKVAISAGIGFFIAFIGLRSAGIVVSNPATSVTLGDLTNPGVLVTVVGLLVIVALYHRKIPGAVMIGILVATLVGAIPGIGVTKYQGIVGPVPDISPTFMKLDFSGFLSLDFWIVVLTFFFVDFFDTLGTITGLAQSAGFMKNGELPRANRAFLADAIGTSVGALFGTSTVTTYIESGAGIAEGGRTGLTALVVALCMLAMLFFAPLAQTVPGYATAPALIFVGALMIGNLGRVKWDDITEALPAFITVITMPLTYSIANGIALGIISYALVKLFSGKSKEVHWFTWILALAFALWLLFIKH

SEQ ID NO: 12290 - protein, 296 aa, Thermotoga maritima MSB8
MRTLKELERELQPRQHLWYFEYYTGNNVGLFMKMNRVIYSGQSDIQRIDIFENPDLGVVFALDGITMTTEKDEFMYHEMLAHVPMFLHPNPKKVLIIGGGDGGTLREVLKHDSVEKAILCEVDGLVIEAARKYLKQTSCGFDDPRAEIVIANGAEYVRKFKNEFDVIIIDSTDPTAGQGGHLFTEEFYQACYDALKEDGVFSAETEDPFYDIGWFKLAYRRISKVFPITRVYLGFMTTYPSGMWSYTFASKGIDPIKDFDPEKVRKFNKELKYYNEEVHVASFALPNFVKKELGLM

SEQ ID NO: 12291 - protein, 291 aa, Thermotoga maritima MSB8
MMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 12292 - protein, 358 aa, Thermotoga maritima MSB8
MKVVIVGNGPGGVELAKQLSEEHEVTIVERETVPYYTKPMLSHYVAGLAEEKSLFPYPIDWYEKKGIKLLLGTTAKRIDAEKKVLETDRGTLEYDVLVLATGAKPRTLKIPGWERMYTLRTIEDAKRLKGAVEREKDLLIIGGGFIGLEIAGNLSKQGIKVKVVEKMTRLMGLDEELTERIKGELEKHGVEFYLGRDVERIENDVLVTDKEEIPARVILCSIGIVPEVSLAKESGLDVNRGILVDKTFRTSKPDIYAIGDCAEHEGIICGTAKAAMAHAKVLANTLKGIPDEYDFHFRSSYFKFGDFPIAIVGELTDRGEWIDSETKSFYRDEKIVGVVVLSDVRKAREWEERLRSTR

SEQ ID NO: 12293 - protein, 330 aa, Thermotoga maritima MSB8
MSKTLKEITDQKNELKKFFENFVLNLEKTEIFSEIQKNLTDEVLFVGCGSSYNLALTISYYFERVLKIRTKAIPAGEVAFQKIPDLEERGLAFLFSRTGNTTEVLLANDVLKKRNHRTIGITIEEESRLAKESDLPLVFPVREEAIVMTKSFSMILLSLMFLADKIAGNSTERFSELVGYSPEFFDISWKVIEKIDLKEHDHFVFLGMSEFFGVSLESALKCIEMSLTFSEAYSTLEYRHGPKALVKKGTLVFMQKVSGMDEQEKRLRKELESLGATVLEVGEGGDIPVSNDWKSAFLRTVPAQILGYQKAISRGISPDKPPHLEKTVVL

SEQ ID NO: 12294 - protein, 464 aa, Thermotoga maritima MSB8
MRYSLFKNYLPKEEVPEIRKELIKLALPAMGENVLQMLFGMADTAFLGHYSWKAMSGVGLSNQVFWVVQVVLIAASMGATVTIANAIGAGNRKAVRSLAWNSVFLAIFTGVILTALTPLSDVLINIFPNLEGEIESSAKEYLKVILSGSMGFSIMAVFSAMLRGAGDTRTPMIVTGLTNFLNIFLDYAMIFGKFGFPEMGVRGAAVATILSRFVGAGILTYVIFKREEFQLRKGLVPPKWSSQKEILRVGFPTAIENFVFSTGVLMFANILLIAGAEAYAGHRIGINVESLSFMPAFGISVAITTLVGRYNGMGNKEHVLGVIRQGWILSLLFQVTVGIIIFLFPEPLIRIFTSDPQIIEISKLPVKIIGLFQFFLAIDSTMNGALRGTGNTLPPMIITFISIWTARLPVAFVMVKYFQLGLLGAWIGMIADIIFRSTLKLLFFLSGKWEKRAVLTRERVKELG

SEQ ID NO: 12295 - protein, 369 aa, Thermotoga maritima MSB8
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFRDFENIFNRDIFDVFFGERPHQEERREYARRGEDIRYEIEVTLSDLINGAEIPVEYERYETCPRCGGTGVEPNAGYMDCPSCGGTGRIREERRSFFGYFVSERTCERCGGTGKIPREYCHECGGSGRVLRKVRRTVKIPPNVEDGTHLRITGGGNAGYYGGPYGDLIIIVRVKPDPRFKKSGSDLVYDVTIDYLQAILGTTVEVPLPEGGTTMLKIPPGTQPETVFRLKGKGLPNRYGRRGDLIVNVHVEIPKSLSREERKVLEELAKKRGVTIG

SEQ ID NO: 12296 - protein, 427 aa, Thermotoga maritima MSB8
MEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERIAKYNQLLRIEEELGKVAEFRGLKSFYSIKR

SEQ ID NO: 12297 - protein, 430 aa, Thermotoga maritima MSB8
MDWKKYGYNTRALHAGYEPPEQATGSRAVPIYQTTSYVFRDSDHAARLFALEEPGFIYTRIGNPTVSVLEERIAALEEGVGALAVASGQAAITYAILNIAGPGDEIVSGSALYGGTYNLFRHTLYKKSGIIVKFVDETDPKNIEEAITEKTKAVYLETIGNPGLTVPDFEAIAEIAHRHGVPLIVDNTVAPYIFRPFEHGADIVVYSATKFIGGHGTSIGGLIVDSGKFDWTNGKFPELVEPDPSYHGVSYVETFKEAAYIAKCRTQLLRDLGSCMSPFNAFLFILGLETLSLRMKKHCENALKIVEFLKSHPAVSWVNYPIAEGNKTRENALKYLKEGYGAIVTFGVKGGKEAGKKFIDSLTLISHLANIGDARTLAIHPASTTHQQLTEEEQLKTGVTPDMIRLSVGIEDVEDIIADLDQALRKSQEG

SEQ ID NO: 12298 - protein, 490 aa, Thermotoga maritima MSB8
MKEIDELTIKEYGVDSRILMERAGISVVLAMEEELGNLSDYRFLVLCGGGNNGGDGFVVARNLLGVVKDVLVVFLGKKKTPDCEYNYGLYKKFGGKVVEQFEPSILNEFDVVVDAIFGTGLRGEITGEYAEIINLVNKSGKVVVSVDVPSGIDSNTGKVLRTAVKADLTVTFGVPKIGHILFPGRDLTGKLKVANIGHPVHLINSINRYVITREMVRSLLPERPRDSHKGTYGKVLIIAGSRLYSGAPVLSGMGSLKVGTGLVKLAVPFPQNLIATSRFPELISVPIDTEKGFFSLQNLQECLELSKDVDVVAIGPGLGNNEHVREFVNEFLKTLEKPAVIDADAINVLDTSVLKERKSPAVLTPHPGEMARLVKKTVGDVKYNYELAEEFAKENDCVLVLKSATTIVTDGEKTLFNITGNTGLSKGGSGDVLTGMIAGFIAQGLSPLEASTVSVYLHGFAAELFEQDERGLTASELLRLIPEAIRRLKE

SEQ ID NO: 12299 - protein, 439 aa, Thermotoga maritima MSB8
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTADNAQTVKLVIKTMAIFHGYHATFMPKPFYGVNGSGMHVHMSLFRGDKNAFYDPDDPLGLSKELRYFVGGILKHAKALAAVTNPTINSYKRLVPGYEAPVYISWSVGNRSALIRIPKARGKATRLEYRSPDPSCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 12300 - protein, 333 aa, Thermotoga maritima MSB8
MGIPKRKLGERGPEVSAIGLGCMRMSFGQKKLPDRKEMIKLIRTAVELGINFFDTAEVYGPYTNEELVGEALEPFKGEVVIATKFGFELYEDGRPGWKGLNSNPEHIKKAVEGSLRRLRVEAIDILYQHRVDPNVPIEEVAGAVKELIEEGKVKHFGLCEASAETIRRAHKVCPVDVVQYEYSMWWRKPEEELLPTCEELGIGFVAYSPLGKGFLTGAIGENSKFDEEDSRSRIPRFQKENLRENLALVELRKTIAERKGATPSQIALAWLLAQKPWIVPIPGTTKLSHLLENIGGAFVELTPEELQEINDALSRIEIKGSRYPEDMEKMTYL

SEQ ID NO: 12301 - protein, 422 aa, Thermotoga maritima MSB8
MAVIFILILMVLLNADQMVMSPNIGAIEQEFNITDAQIGLVASSFTVIGALVSLVWGYLADRYSRKNLLIYSILVGEIPCLMSAFSRSYGELFFWRALTGIGVGASFPIVYSMIGDMFDEVKRGKVVALISSAISIGSVLGMIVGGFLGPKYGWRVPFIAVSVPNIFFAVLSIFVLKEPKRGAFEKGIGELVQSGYEYPKAPKLSDYAKLVKVKTNLLLFFQGIAGTIPWGAIPYFLVEFFRRERGLSVETATLVFLVFGLGNIVGIILGGLWGASIYAKSRPFLPLFCSITTALGTFFTVMTLDYMGSLLVLMLLGFIASFTASLTGPNVKFMLLNVNEPQERGRIFSIFNLTDSLGTGFGKFAGGVMSVALGSLGAALKVSAYFWLICAVLLFVLVFYFAKDVERLQKTMIELAKNSQTR

SEQ ID NO: 12302 - protein, 336 aa, Thermotoga maritima MSB8
MMKALILAGGSGERFWPLSTPETPKQFLKLFGNKSLMRWTFERVLEEMDPKDVIVVTHKDYVERTKKELPELPDENIIAEPMKKNTAPACFIGTKLADDDEPVLVLPADHRIPDTKKFWKTVKKALDALEKYDGLFTFGIVPTRPETGYGYIEIGEELEEGVHKVAQFREKPDLETAKKFVESGRFLWNSGMFLWKAREFIEEVKVCEPSIYENLKDVDPRNFEELKKAYEKVPSISVDYAVMEKSKKVRVVKADFEWSDVGNWSSVREIEGYTEESDEVILVDSDRVFVKTHNKPIAVVGLSDVIVIDTPNGILICKEEYAQKVREVVKKLFRTS

SEQ ID NO: 12303 - protein, 197 aa, Thermotoga maritima MSB8
MMTLYPVVVQERTTGEVLMLAYANEEALELTKKTGYAHFFSRERQKIWKKGETSGNTMRVVEIRRDCDDDAYLYIVDFPEDKVACHTGNRSCFFKVEHRFEETGSPTFWLELYRLVRKRKEEMPEGSYTVKLFKEGKGKIAKKFGEEAVEVITGYLQNDRENLVWEIADMMYHLTVLMADAGVTVQDVMRELEKRRK

SEQ ID NO: 12304 - protein, 452 aa, Thermotoga maritima MSB8
MKRILVSLYEKEKYLDILRELHEKGWEIWASSGTAKFLKSNGIEANDVSTITGFENLLGGLVKTLHPEIFAGILGPEPRWDVVFVDLYPPPDIDIGGVALLRAAAKNWKKVKPAFDMETLKLAIEIDDEETRKYLAGMTFAFTSVYDSIRANQFVEGISLAFKREDLQLRYGENPHEKAFVYGKPAFEILHEGKTISFNNILDAENAWFMAKNLPRMGAVVVKHQSPCGAAIGEDKVEIVKKAIEADDESSFGGILAVNFEMDEEVAKSLKKYLEVIVAPSFTQEAIEVLSKKKVRLLKPGDYASWAGKMAFGSLVLSERKYPEGNFELVVGEPLSEKELEDLEFAYRVVEGAKSNAVLIAKDGVTVGIGSGQPSRKRAAWIATVMAGEKAKGAVAASDAFFPFPDSLEILAQAGVKAVVAPLGSIRDEEVIEKARELGITFYKAPSRVFRH

SEQ ID NO: 12305 - protein, 379 aa, Thermotoga maritima MSB8
MNTDDILFSYGEEDIPLKALSFPIFETTNFYFDSFDEMSKALRNGDYEFVYKRGSNPTTRLVEKKLAALEECEDARLVASGMSAISLSILHFLSSGDHVVCVDEAYSWAKKFFNYLSKKFDIEVSYVPPDAERIVEAITKKTKLIYLESPTSMRMKVIDIRKVTEAAGELKIKTVIDNTWASPIFQKPKLLGVDVVVHSATKYISGHGDVMAGVIAGDVEDMKNIFVDEYKNIGPVLSPIEAWLILRGLRTLELRMKKHYENALVVSDFLMDHPKVLEVNYPMNPRSPQYELASSQMSGGSGLMSFRLKTDSAEKVKEFVESLRVFRMAVSWGSHENLVVPRVAYGDCPKKDVNLIRIHVGLGDPEKLVEDLDQALKKI

SEQ ID NO: 12306 - protein, 482 aa, Thermotoga maritima MSB8
MKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYIGARTIKELQEKAVFVKITPAGVKESHPHDIIITKESPNYWVQA

SEQ ID NO: 12307 - protein, 368 aa, Thermotoga maritima MSB8
MIGGEVSIKNVSKFFDDFQVLKNVSLDIKKGEFFSILGPSGCGKTTLLRVIAGFEGVESGDVLLDGKSILNLPPNKRPVNIIFQNYALFPHLTVFENIAFPLKLKKLSENEINQRVNELLSLIRMEEHAQKMPSQLSGGQKQRVAIARALANEPRVLLLDEPLSALDAKLRQELLVELDNLHDRVGITFIYVTHDQAEAISVSDRVALMNEGEIVQVGTPYEVYESPVNVFAATFIGETNLMKAEVVEVEDEYYVVESPGIGQFRCYRDKEAKKGDRLLITLRPEKIRISRKQFRSEETFNVFHGVVDEEIYMGHQTKYFVRLDEGYIMKVYKQHARYILDEPIIKWEDEVFITWNPDDSFIVEVLEE

SEQ ID NO: 12308 - protein, 448 aa, Thermotoga maritima MSB8
MSLKFDFSNLFEPNISGGLTDEDVKSVEEKVTSAVRNFVENTPDFAKLDRSWIDSVKSLEDWIINFDTVVVLGIGGSGLGNLALHYSLRPLNWNEMTREERNGYARVFVVDNVDPDLMSSVLDRIDPKTTLFNVISKSGSTAEVMATYSIARGILEAYGLDPREHMLITTDPEKGFLRKLVKEEGFRSLEVPPGVGGRFSVLTPVGLLSAMAEGIDIDELHEGAKDAFEKSMKENILENPAAMIALTHYLYLNKGKSISVMMAYSNRMIYLVDWYRQLWAESLGKRYNLKGEEVFTGQTPVKALGATDQHSQIQLYNEGPNDKVITFLRVENFDREIVIPETGRAELSYLARKKLSELLLAEQTGTEEALRENNRPNMRVTFDGLTPYNVGQFFAYYEAATAFMGYLLEINPFDQPGVELGKKITFALMGREGYTYEIKERSKKVIIE

SEQ ID NO: 12309 - protein, 234 aa, Thermotoga maritima MSB8
MSVYLAEFLGTMLLIILGDGVVANVVLKKSKGHNSGWIVITTGWGLAVAMSVYLVGRISGAHINPAVTIGLAFIGQFPWSKVPGYIFSQILGAFVGAILVYLTYLPHWKETDDPDAKLAVFCTGPAVRKYGANLLTEIIGTMVLLMGVLGIGANKLADGLNPLLVGFLVWSIGLSLGGPTGYAINPARDFGPRLAHAILPIPGKRDSDWSYSWVPIIGPIIGGILGASLYNWLF

SEQ ID NO: 12310 - protein, 220 aa, Thermotoga maritima MSB8
MMAYLVFLGPPGAGKGTYAKRLQEITGIPHISTGDIFRDIVKKENDELGKKIKEIMERGELVPDELVNEVVKRRLSEKDCERGFILDGYPRTVAQAEFLDGFLKTQNKELTAAVLFEVPEEVVVQRLTARRICPKCGRIYNLISLPPKEDELCDDCKVKLVQREDDKEETVRHRYKVYLEKTQPVIDYYDKKGILKRVDGTIGIDNVIAEVLKIIGWSDK

SEQ ID NO: 12311 - protein, 422 aa, Thermotoga maritima MSB8
MRIDEIVEKYVDRKTQRRFLILTSIAWMFDAAGVMLLSFVLPYVIKEWNLTSTQGATIASATFLGMLFGALSVGFVADLLGRKVSNLFFFIVTITFTFLSGFSSSFETLLVLRGLSGFGYGGLMPSFNAYLAEFTSIRLRGRYLVLLESSWAVGSILIGLFAVNVLPNWRWVFWIFSIGYLFVPVFLRMPETPKYAFLKGGKEALERSLGKRVEEEVELPKKEKVPILALLKREHLKDTVVIWIAWFVVSFVYYALFTWAPRIFSSLGVSVVKSSWFTFYMMVAQLPGYLSAAYFIEKWGRKASLGVYFIGTGLAALLWANVRGDASLLAAALVLSFFCLGVWGLVYAYTPELYPTSLRGTGNGAAGVWARIAGIIAPYYTGFMMEKGKSIAETLAWISAMAMFAGVIVLIFGRETKGKYVD

SEQ ID NO: 12312 - protein, 468 aa, Thermotoga maritima MSB8
MKNRKTPMKEQSPESRRRNFEEVALGYTLEEALEEAQRCLQCPTHPCVSGCPVEIDIPGFIRKLRDGKLEESYRILKSYNNLPAVCGRVCPQEVQCESRCVVGKMKDSEPVAIGRLERFVADWAAENLEEDVKPLAGSKKEKVAVVGSGPAGLTAAADLAKMGYHVDIFEAFHKPGGVLVYGIPEFRLPKRIVEREVSYIRKLGVNFHLNTVVGKTVKVKELLSEYDAVFIGTGAGTPKFMGIPGTNLNGVYSANEFLTRVNLMKAYLFPEYDTPIRVGKKVAVIGAGNTAMDAARSALRLGAEKVYIVYRRTEREMPARREEYHHALEEGIEFLWLTLPIRYIGDANGNVEAMECVRMELKEADGSGRPRPVPIEGSNFVLEVDMVIEAIGQGPNRVLLSEFPGLELNERGYIKADEDTGATSVKGVFAGGDIVTGAATVIKAMGAGKKAAQFIHSYLTGEWNPWQK

SEQ ID NO: 12313 - protein, 422 aa, Thermotoga maritima MSB8
MNFKRLIIYEAFARAYPGEKGKKFDSLIKDLERLKGMGINTVWLMPIHPTGIEGRKGTLGSPYAIRDYYEIDPLIGTKDDFKRFVKRAHELNMYVLMDMVLNHAAADNVLVREHPEWFLRDEKGNPTRKVPDWTDIVDFDYSNGELRKYMINMMKYWVEEFDVDGFRCDVAGLVPLDFWLQARKELDPVKRLIWLSETHDPYMYQAFDITYDYDGYYKFRDFIEGRGSLREYVDFLRMQDHMYPRGYIKMRFLENHDQPRIAKFIEEDSLVHWIAFLFTFKGVPLVHNGQEYGLKEDVDIFNEYTLPFPMEENRISILHRKLAHYRYGTSVFSEGEMLFVKNDQPEKVISYLWRYENRYILCMLNPLLENTKVTLDFSGIWESACIHSKNVFNDEIVRVPVKNSRATVEIGKEPLILSFVLY

SEQ ID NO: 12314 - protein, 220 aa, Thermotoga maritima MSB8
MVKIAASILACDLARLADEVKRVEEHVDMIHFDVMDGHFVPNISFGLPVLKALRKETKLPISVHLMITNPEDYIDRFIEEGADMVAIHYESTFHLHRLVHRVKDLGARAFVAINPHTPINLLSEIITDVDGVLVMSVNPGFSGQRFIARSLEKIRNLRKMVKELGLETEIMVDGGVNEENASILVKNGATILVMGYGIFRNDNYVELIKSIKQEREEFAD

SEQ ID NO: 12315 - protein, 385 aa, Thermotoga maritima MSB8
MYLMNTYSRFPATFVYGKGSWIYDEKGNAYLDFTSGIAVNVLGHSHPRLVEAIKDQAEKLIHCSNLFWNRPQMELAELLSKNTFGGKVFFANTGTEANEAAIKIARKYGKKKSEKKYRILSAHNSFHGRTLGSLTATGQPKYQKPFEPLVPGFEYFEFNNVEDLRRKMSEDVCAVFLEPIQGESGIVPATKEFLEEARKLCDEYDALLVFDEVQCGMGRTGKLFAYQKYGVVPDVLTTAKGLGGGVPIGAVIVNERANVLEPGDHGTTFGGNPLACRAGVTVIKELTKEGFLEEVEEKGNYLMKKLQEMKEEYDVVADVRGMGLMIGIQFREEVSNREVATKCFENKLLVVPAGNNTIRFLPPLTVEYGEIDLAVETLKKVLQGI

SEQ ID NO: 12316 - protein, 473 aa, Thermotoga maritima MSB8
MMYPMPSWVYDSVVYQIFPDRFFIGKGKTVEDKKDLYLKRGGVIEKWGVPPRKLPGAQHVKIFYGGDLWGIAEKVDYFEELGINVLYLTPIFLSDTNHKYDTIDYFRVDPQFGGKRAFLHLLRVLHERSMKLILDGVFNHVGSQHPWFKKAKKNDPEYVNRFFLYKDRHRSWFDVGSLPELNVEVEEVKEYILKVVEHYLKLGIDGWRLDCGHDLGPTVNLWINMKVKEFSAEKYLVSEIWTYPAGWDMVDGLMNYNFRNLVLSYVNGETDSIGFHLERAYRETKNIFGCWNMLDSHDTPRLATMVPDRDLRKLAVVLQFTYPGVPLVYYGTEIGLTGGEDPECRATMEWNREKWDVDLFEFYKKMIRLRRTDPGLRFGEFVLLNDSPLAFLRKAPHPLQNTIVVVNPGEEKVLVLSIPDGKIMNTTPLVDVFSGERFHVDGGVVKLPLLARSFRILKPEDLRVGKYRLYKRV

SEQ ID NO: 12317 - protein, 384 aa, Frankia sp. EuIK1
MTELDPEERAVVDTVRDFVDREVRPVVRGLEHADVYPEALIEQMKRLGVFGLAIPEPYGQVDVSTVCYVLVTEELARGWMSLAGAMGGHTVVSKLLLEYGTEEQKQRYLPRMATGELRATMALTEPGGGSDLQAMRTGARPAGGGYVINGSKTWITNARRSGLVALVCKTDPGVEPAHRGMSILLVEKGPGFEVSRDLPKLGYKGVESCELSFTDCRVPREALLGGVEGRGFGQMMRGLEVGRLQVAARATGVGRAAFDDALRYAQERESFGRPIWQHQSVGNHLADMATKLTAARQLLLHAARRYDTGERADLEAGMAKYFCSEVAMEVALSAIRVHGGYGYSTEFDVERYFRDAPLMIVGEGTNEIQRNVIAAQLVKRGGLP

SEQ ID NO: 12318 - protein, 355 aa, Chara corallina
LELRDGGKDFMGKGVLKAVSNVNDIIAPALIGKDVTEQTAIDKFMVEDLDGTQNEWGWCKQRLGANAILAVLLAVCKAGAGAKKIPLYQHIANLAGNSKLVLPVPSFNIINGGSHAGNKLAMQEFMILPTGASSFQEAMKIGSEVYHHLKSIIKKKYGQDATNVGDEGGFAPNIQDNKEGLELIKAAIEKAGYTGKVTIGMDVAASEFYSDKTKMYDLDFKTEHNDGSKRITGDQLIQLYESFCSEYPLVSIEDPFDQDDWEHYAKLTALIGEKVQIVGDDLLVTNPKRVAKAIAEKSANALLLKVNQIGSVTESIEAVRMSKKAGWGVMTSHRSGETEDTFIADLAVGLATGQI

SEQ ID NO: 12319 - protein, 355 aa, Nitella opaca
LELRDGGKDFMGKGVLKAVSNVNDVIAPALIGKDPTEQTALDNFMVEELDGTQNEWGWCKQRLGANAILAVSLAVCKAGAGAKKIPLYQHIANLSGNTKLVLPVPSFNIINGGSHAGNKLAMQEFMILPTGASSFKEAMKMGSEVYHHLKSIIKKKYGQDATNVGDEGGFAPNIQDNKEGLELIKAAIEKAGYTGKVTIGMDVAASEFYDEKTKMYDLDFKTENNDGSKRISGDEIIQLYKSFCDEYPLVSIEDPFDQDDWEHYAKFTALIGEKVQIVGDDLLVTNPKRVAKAVAEKSANALLLKVNQIGSVTESIEAVRMSKKAGWGVMTSHRSGETEDTFIADLAVGLATGQI

SEQ ID NO: 12320 - protein, 355 aa, Nitellopsis obtusa
LELRDGGKEFMGKGVLKAVSNVNDIIAPAVIGMDPADQTKIDELMVQQLDGTQYEWGWCKQKLGANAILAVSLAVCKAGAGVLNVPLYQHIANLAHNPNLILPVPSFNIINGGSHAGNKLAMQEFMILPTGASSFKEAMKMGTEVYHNLKSIIKKKYGQDATNVGDEGGFAPNIQDNKEGLELIKEAIAKAGYTGKVTVGMDVAASEFYTEASKTYDLNFKTDNNDGSGKISGQQIIELYQSFCEDYPMVSIEDPFDQDDWEHYAKFTALIGEKVQIVGDDLLVTNPKRVAKAIAEKSCNALLLKVNQIGSVTESIEAVRMAKKAGWGVMTSHRSGETEDSFIADLAVGLATGQI

SEQ ID NO: 12321 - protein, 359 aa, Pycnococcus provasolii
VELRDKDTAPDDYMGKDVLQAVSHVNREITTLHVGKVPTDQKAIDVAMIALDGTENKGRLGANAILTASIAVCKAGAAESGVPLWRHIGKLANNVTFVLPVPAFIIINGGSHAGNRLAFQEYMILPTGASSLTEAMKMGSEVYHKLKDIIKAKYGQDSVNVGDEGGFAPSLENNEEGLKLIVEAIEVAGYTGKVKIGMDVAASEFLVPAASEIAIYKYDLDFKAPEGAAKDEKLAAMPGDELRALYASFVQNYPVISIEDPFDQDDAENTTALTADDLCQIVGDDLLVTNPKRVQRAIDGKWCNALLLKVNQIGSVSEAIEAVGMSKNAGWGVMTSHRSGETEDSFIADLAVGLATGQI

SEQ ID NO: 12322 - protein, 348 aa, Pycnococcus provasolii
VELRDGDKSMWMGKGCSKAVANLNDIIAPALVGKDPTQQKAIDDLMNKELDGTENKGKLGANAILAVSMAVCKAGAAEKDIPLYKYIAELAGNTKLILPVPAFNIINGGSHAGNKLAMQEFMTLPTGATSFTEAMKMGTEVYHNLKSVIKEKYGQDACNVGDEGDFAPNIESNKEGLDLVNQAIEKADSTGKVKIGMDVASSEFYTEDKMYDLDFKTKDNDGSQKKTGEEMLEMYKSFCSEYPVISIEDPYDQDDFENTAALTAEGVCQVVGDDLLVTNPTRVASAIEGKTCNALLLKVNQIGSISEAIEAVRMSKEAGWGVMTSHRSGETEDSFIADLAVGLATGQI

SEQ ID NO: 12323 - protein, 375 aa, Mastocarpus papillatus
VATAGGKFSAMVPSGASTGIYEALELRDGDKSSYLGKGVDKAVANVKDKISEAIMGMDASDQGAVDAKMIELDGTEGGFKKNLGANAILGVSMAVARAGANAKGVPLYKHLNNLAGNPKMLLPVPSLNVINGGTHAGNKLAMQEFMILPVGASTFREAMKMGAETYQYLKKVIKKKYGLDATSVGDEGGFAPNIQDNTEGLKLLEEAIEMAGYTGKIKVGMDVAASEFWKEDKEVYDLDFKNDDNDGSQCLTGEKLGEMYKDFISNFPMISIEDPFDQDDWESYAKLTAAVGEGVQIVGDDLLVTNPNRIQTGIDKKACNALLLKVNQIGSITEAIQASKMSRDAGWGVMVSHRSGETEDNFIADLCVGLGTAQI

SEQ ID NO: 12324 - protein, 373 aa, Mastocarpus papillatus
VETDDGKFRAMVPSGGSTGIHEAHEMRDGDENKFSGKGVLKAIKNVNNEIAVTVIGMDPTDQEGIDQALADLDGQPDKSRLGANAILGVSMAVTRAGAAKKGIPLYKHINNLAGNPTPILPVPSFNVLNGGSHAGNPLAMQEFMILPTGAESFKEAMQVGVEVYHKLKSVIKQKYGQSSTSVGDEGGFAPNIKDSEEALELIQTAVKEAGHSDIVQIGMDVAASEFYNKETKKYNLNFKNPAGSTNPAGMKSADELLRMYKLFAANYGVISIEDPFDQDDFTSFEKMTGELNELIQIVGDDLLVTNPERIERAIERNACNALLLKLNQIGTVTEAIEANNLARNAGFGVMVSHRSGETEDSFIAALCAGLGTG

SEQ ID NO: 12325 - protein, 375 aa, Prionitis lanceolata
VTTADGKFSAMVPSGASTGIYEALELRDGDKSAYLGKGVDKAVANVKDKIAPAISGMDAADQAAVDKKMIELDGTEGGFKKNLGANAILGVSMAVARAGAAAKRVPLYKHLNDLAGSPKMLLPVPSLNVINGGSHAGNKLAMQEFMILPVGATSFREAMKMGAETYQYLKKVIKKKYGLDATSVGDEGGFAPNIQDNTEGLRLLEEAIEMAGYTGKIKVGMDVAASEFWKDDTKMYDLDFKNPDNDGSQCLSGEKLGELYKEFVAKFPMISIEDPFDQDDWESYAKLTEAVGESVQIVGDDLLVTNPDRIRTGIEKKACNALLLKVNQIGSVTEATQASQISRDAGWGVMVSHRSGETEDTFIADLCVGLGTAQI

SEQ ID NO: 12326 - protein, 377 aa, Prionitis lanceolata
VETDDGNFRAMVPSGASTGIYEAHELRDGDPKVFNGKGVLKAIDNVNNELAVAVTDMDPTDQGGIDQALVDCDGSSDSSKSRLGANAILGVSMAVARAGAAKKGIPLYKHINNLAGNPTLMLPVPCFNVINGGSHAGNGLAFQEFMILPTGAETFKEAMRIGVEVYHKLKRTLEESYGKASTAVGDEGGFAPDIHDNEQALKLVQSAVKESGYEGVIQIGLDVAASEFYDKESGRYNLSLKTKVNGAAAGQLRSASELLHTYKLYAANYGVTSIEDPFDQDDFPSFESMTAELGEVIQIVGDDLLATNPNRIETAVERSACNALLLKLNQIGTVTEAIEANNTARDAGFGVMVSHRSGETEDPFIAALCVGLGTGQI

SEQ ID NO: 12327 - protein, 142 aa, Prionitis lanceolata
LTTDLGLFRAAVPSGASTGAYEALELRDGDKSRYNGKGVLKAISNVNELIAPAVAGADVIDQAAFDAIMLELDGTENKAKLGANAILGVSMAACMAGAAAKGIPLYRHISEIAGKGSDPVIMPVPVMNVINGGSHAGNKLAM

SEQ ID NO: 12328 - protein, 347 aa, Rhodomonas salina
CELRDGDDKRYLGKGVLKAVENVKSVIAPALAGMNPVEQDAVDNKMIQELDGTPNKTKLGANAILAVSLACCKAGAAQKGVPLYKHIADLAGTKKICLPVPWMNVINGGSHAGNRLAMQEFMIGPVGAKTFKEAMQMGCEVYHTLKKVIKKKYGQDACNVGDEGGFAPNIQANDEGLKLLTEAIEMAGFTGKIKIGMDVAASEFCKDKKYDLDFKNDASKPEDYLSPDALTDMYKGFCKDFPVVTIEDPFDQDDWEAYTKMTGEMECQIVGDDLLVTNPTRITTALEKKACNALLLKVNQIGSVSESIKAAKMSMDSNWGVMCSHRSGETEDCFIADLVVGLGTGQI

SEQ ID NO: 12329 - protein, 347 aa, Guillardia theta
CELRDGDKSRYLGKGVSKAVKNVEEKIAPAIKGMDPTDQEGIDKKMIEVDGTPNKTNLGANAILAVSLAVAKAGAAQKGVPLYQHFADMAGVKKYVLPVPWMNVINGGSHAGNRLAMQEFMIGATGATSFKEAVRMSCEVYHALKAVIKKKYGMDACNVGDEGGFAPNIQDNKEGLSLLTEAIANAGYTGKIKIGMDVAASEFYQDGKYNLDFKNANADPSMVVSGDELIEVYKSFTQDFPVVTIEDPFDQDDWEHYNKFNSQMPHTQIVGDDLLVTNPNRITMAIEKKACSGLLLKVNQIGTVSESIKACKMSQEQGWGVMRSHRSGETEDTTIADLVVGLATGQI

SEQ ID NO: 12330 - protein, 347 aa, Pedinomonas minor
LELRDGDKTHYMGKSVEKAVDNINKLISPALVGMNPVNQREIDNAMMKLDGTDNKGKLGANAILAVSMAVCKAGAAEKGVPLYKHIADVAGVKKLVLPVPAFNIINGGMHAGNNMPMQEFMVLPTGAKSFKEAMKMGCEVYHTLRTLIKKKYGQDACNVGDEGGFAPNVASAEEALKMVDQAINDAGYKGKVTIGMDVAASEFYTQDKCYDLGFKMKNNDGSLKMTGKQMQELYAKFCKEFPIISIEDPFEQDDFANWTEITAANSCQIVGDDHLVTNPKRVKQAIEAKSSNALLLKVNQIGTISESIDAVRMSKEAGWGVMTSHRSGETEDSFIADLAVGLATGQI

SEQ ID NO: 12331 - protein, 139 aa, Chlamydomonas reinhardtii
YTRKGMFRAAVPSGASTGVHEAVELRDGDKSKYLGKGVTKAVENINAIIAPALKGMDPVKQAEIDQKMKDLDGTDNKGKLGANAILAVSMAVCKAGAAEKGVPLYKHIADLAGNSKLILPVPSFNIINGGSHAGNALAM

SEQ ID NO: 12332 - protein, 140 aa, Scenedesmus rubescens
VTTYKGTFRAAVPSGASTGIHEAVELRDGDKSQWMGKGVAKAVGNVNNDIAPALLGKDPTQQKEIDDAMIALDGTENKGKLGANAILAVSMAVAKAGAAEKGVPLYKYIAQLAGNSKLVLPVPSFNVINGGEHAGNGLAM

SEQ ID NO: 12333 - protein, 118 aa, Nephroselmis olivacea
VELRGGDKAKWMGKGVLKAVENLNSKIAPALIGKDPRNQRELDDLMNSLDGTENKGNFGANAILAVSMAACKAGAAEKGVPLYQHIADLAGNKKLILPVPAFNVINGGSHAGNKLAMQ

SEQ ID NO: 12334 - protein, 391 aa, Methanocaldococcus jannaschii DSM 2661
MFEVKHMDGIDVFFFMWAASLIFFMKAGFIALEIGQFRAKNVSYHCVLKLLDLAAVFIAYLFIGYGISYGFENIMPLITGTFDADLGAWWMKMVMFAAAAVTIITGGVAERIKILPYFIGALIVGGILYPIVEHLVWGGGFANLGINFHDYAGSGAVHLFGGLVGLMAAYVLGPRIDKYINGKPQAIPGHNIPIAVLGAFILAFGWYGFNIGSASGIANGVELASVAMATTMALAGGIIGGALSSRNDPLYTANGMCAGLVAVCSGVDLFTPIGAFIVGLLAGIQQPFTYKFIEEKLKIDDVCAIGPVHAMSGLIGVICAGIPFLLKADAVSKVSITGQIIGAIVIALIAIVGGLIIYKGLDLTIGLRVSEEAEKVGLDTAILQTTAYSEE

SEQ ID NO: 12335 - protein, 447 aa, Methanocaldococcus jannaschii DSM 2661
MVGMMRKTKILVTLGPSLENKLDKAINLIDGVRFNMSHATTDYCEKFLNILEKNNIAKVMDLKGIKIRIKEVKLKNKILKMGEKVVIGEDIKLNYNIDTIEEGHFILINDGKIKLRVVEKTDKIIAVVEVGGEIKEGMGVNLPDTRIELPIIDETDLKNIKFAVEKDFEYIALSFVRNKEDVKELKDIISEYKGDCEVISKIETKEGLKNIKEIARESDGVMVARGDLGVEVPIENIPIEQKNILRIANRYGILSITATQILDSMINNPFPTRAEVTDIANAIYDGTDCLMLSNETTIGKYPIEAIKVLNKVAKVADEHYEEFGDRVCLEVESIDEGLVYAVYELYKKLNTKLVITPTYSGRTAKLISKLRINSKIIAPTPNIRTLKRLRLVWGVESCLMEEFDDMEKIINTCREMAKKEIGKGIYLITLGHPIGQKKTNTIKVESI

SEQ ID NO: 12336 - protein, 427 aa, Methanocaldococcus jannaschii DSM 2661
MLYNMDERFEIKDIVAREVIDSRGNPTVEVEVITKGNGYGSAIVPSGASTGTHEALELRDKEKRFGGKGVLMAVENVNSIIRPEILGYDARMQREIDTIMIELDGTPNKSRLGANAILAVSLAVAKAAAATAKIPLYKYLGGFNSYVMPVPMMNVINGGKHAGNDLDLQEFMIMPVGATSISEAVRMGSEVYHVLKNVILEKYGKNAVNVGDEGGFAPPLKTSREALDLLTESVKKAGYEDEVVFALDAAASEFYKDGYYYVEGKKLTREELLDYYKALVDEYPIVSIEDPFHEEDFEGFAMITKELDIQIVGDDLFVTNVERLRKGIEMKAANALLLKVNQIGTLSEAVDAAQLAFRNGYGVVVSHRSGETEDTTIADLSVALNSGQIKTGAPARGERTAKYNQLIRIEQELGLSKYAGRNFRCPF

SEQ ID NO: 12337 - protein, 284 aa, Methanocaldococcus jannaschii DSM 2661
MEEHFIDLSKFMMANCPYEEAEGVIFSIPYDETTSFKPGAREGGNAIRTASWGLETYSPILDRDLAELKYCDLKDLDLYGSQEEIFGTIHSVSREILKENKKIIVFGGEHSITYPIIKAVKDIYDDFIVIQFDAHCDLRDEYLGNKLSHACVMRRVYELTKNIFQFGIRSGDKEEWDLARKNNLYLKMDLMNKDDLEYIKSLDKPIYVTIDIDVLDPAYAPGTGTPEPCGFSTRELFNSLYLLEEVKDKIIGFDIVEVSPIYDIANITAITAAKIARELMLMIL

SEQ ID NO: 12338 - protein, 293 aa, Methanocaldococcus jannaschii DSM 2661
MNQNNDFKCHIWFTEYHNNNVALSVRVKDILYREKSGFQEIEIIDTYDFGKALILDNTFQTTERDEFIYHELISHIPLFTHPNPRNVLVIGGGDGGTVREVVKHKSVETVDFVELDEKVIEACKKYMPKLSCEIDNEKVNLIITDGIKYVAETEKKYDVIIVDCPDPVGPAKGLFEKEFYKNVFKCLNDDGIMVQQSESPLYNLDLIQNICRYLKDAGFKIIMPYTYPMPTYPSGFWSFTLASKKYNPLEVDEARIKEALKDMETKYYDEEVHKGIFLAAPKFLKDAVKKALE

SEQ ID NO: 12339 - protein, 436 aa, Methanocaldococcus jannaschii DSM 2661
MIMKFVEKYFEFEKYGTNLKVETLAGITTFMTMAYIIFVNPQILSTAGMDFGAVMVATCIASAIATLVMGLYARYPFALAPGMGLNAYFTYGVCLGMGIDWRVALGAVFISGVLFIILTLTKIRTWIFNVIPNAIKYGTAVGIGLFIAFIGLKSAGIIVSSKATLVTLGNLMEPSTLLALFGIFLTSILVSRNVIGAILIGIIVTSLIGMILGISPFPEGIFSMPPSIAPTFLQLDIMGALNLGLLTIVLAFFFVDMFDTLGTLSALASQAGYLDKDGKLPRVEKALMADATGTVVGSLLGTSTVTTYIESASGIALGGRTGFVSVVVAMLFLLSLFFYPVVKAIPPYATAAALVIVGALMMRSVKYIDFDDYTEAIPAFITLLTIPLTFSIATGLALGFITYPILKVFTGRWKEVHWLVYVLAVIFALRFVYLSG

SEQ ID NO: 12340 - protein, 290 aa, Methanocaldococcus jannaschii DSM 2661
MRVIILKIKKIFMVMIMIKVAVTGALGRMGSNIIKTITQQEDMKVVCAFEVPNHPKKGEDVGELIGIGKIGVPLSTADELDKVLKETKPDVLVDFTIAHACVENVKIAAKNGVNLVIGTTGFTEEQKAEIEKAIKENNVAAVISQNFAIGVNIFFKTLEFLAKKLGDYDIEIIEMHHRYKKDAPSGTALRAAEIIKANRGIESVFVYGRYGMTGERKKEEIGIHALRGGDVVGDHTVIFAGDGERIELTHRASSRQAFVNGVILAIRYIADKKEGIYNTFDVLGLNEIKF

SEQ ID NO: 12341 - protein, 343 aa, Methanocaldococcus jannaschii DSM 2661
MVSIMPKILYNPEVLGHKPKSYHVENPERVLTILNSLKSNGFDDIVLIEGKSTINEILEIHSRDYVYSIINLSKSFNYYDGDTYLCDRTLDAALTAFKLAKEAVKLALKDRDLYFALTRPPGHHAGISGRALGAMSNGFCIFNNIAGAARLAKNYMKKVIIIDFDVHHGNGTQEIFWNDNRVIHIDFHQRGIYPGTGDILDIGGEEAKGTKINLPFPAHSTDADYIFAWNEIVEPILNYFSPDTVLVSAGFDAFINDGLASMDLTETFYRFVGAKLSGYSVTAVLEGGYSIGLKYAPPAFLDGYVDAKDVLDNLEDYTVINSNEVKSMVKNVKKIIGEYLDIF

SEQ ID NO: 12342 - protein, 445 aa, Methanocaldococcus jannaschii DSM 2661
MVNSSPLWKKLMRKCKGENMALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 12343 - protein, 272 aa, Methanocaldococcus jannaschii DSM 2661
MNKAVIYTLPKGTYSEKATKKFLDYIDGDYKIDYCNSIYDVFERVDNNGLGVVPIENSIEGSVSLTQDLLLQFKDIKILGELALDIHHNLIGYDKNKIKTVISHPQALAQCRNYIKKHGWDVKAVESTAKAVKIVAESKDETLGAIGSKESAEHYNLKILDENIEDYKNNKTRFILIGKKVKFKYHPKNYKVSIVFELKEDKPGALYHILKEFAERNINLTRIESRPSKKRLGTYIFYIDFENNKEKLEEILKSLERHTTFINLLGKYPVFD

SEQ ID NO: 12344 - protein, 417 aa, Methanocaldococcus jannaschii DSM 2661
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 12345 - protein, 208 aa, Methanocaldococcus jannaschii DSM 2661
MKVLLKIIVGRAMNILKNFSVPNLCDAGAKPLNGIKPILENQKLVFGEAITVKISYNDWGTLIKTISFAKNKFIVAEVVGEGKYETAVWGGLASLNAKIKGVRGVVIDGCVRDVEDIKALKFPVFAKNFCPNAGKPLNLGEINVAVNCCGVIVEPGDIIVGDCNGVVVIKKESLPEIIENAKNIKEKERKIRERILRGQDLRDVLNLE

SEQ ID NO: 12346 - protein, 463 aa, Methanocaldococcus jannaschii DSM 2661
MVNRKPNNPNKNGEEMRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 12347 - protein, 234 aa, Methanocaldococcus jannaschii DSM 2661
MIKIGASILSADFGHLREEIKKAEEAGVDFFHVDMMDGHFVPNISMGIGIAKHVKKLTELPVEVHLMVENVDLFVNEFEEMDYITFHIEAVKFPFRIINRIKSIGAKPIVALNPATPLDAIEYILGDVYAVLVMTVEPGFSGQKFIPVMTKKIRKLKSMIVENGYDTKIFVDGGINVETAPLAVKAGADVLVAASAIFGKDDVKTAVKNLREAALEALNKDFLTKSFNSNEEKQ

SEQ ID NO: 12348 - protein, 414 aa, Methanocaldococcus jannaschii DSM 2661
MIYVTFTPYGAFGVKDNKEVSGLEDIEYKKLFNEEEIPDIMFKLKTQPNKIADELKEEWGDEIKLETLSTEPFNIGEFLRNNLFKVGKELGYFNNYDEFRKKMHYWSTELTKKVIKSYAQQKDKIIIQVAEAISDLDKTLNLLSERLREWYSLYFPELDHLVNKHEVYANLITKLGKRKNFTKSQLKKILPSKLAGKIAEAAKNSMGGELEDYDLDVIVKFAEEINHLYEKRKELYNYLEKLMNEEAPNITKLAGVSLGARLIGLAGGLEKLAKMPASTIQVLGAEKALFAHLRMGVEPPKHGIIYNHPLIQGSPHWQRGKIARALACKLAIAARADYVGDYIADELLEKLNKRVEEIRRKYPKPPKKKKKEKPKAKKKEKKGKKEKSKKKKDKKKDKKGKKERKVIGKTKSRK

SEQ ID NO: 12349 - protein, 230 aa, Methanocaldococcus jannaschii DSM 2661
MEDIKIKEIFENIYEVDLGDGLKRIATKSIVKGKKVYDEKIIKIGDEEYRIWNPNKSKLAAAIIKGLKVMPIKRDSKILYLGASAGTTPSHVADIADKGIVYAIEYAPRIMRELLDACAERENIIPILGDANKPQEYANIVEKVDVIYEDVAQPNQAEILIKNAKWFLKKGGYGMIAIKARSIDVTKDPKEIFKEQKEILEAGGFKIVDEVDIEPFEKDHVMFVGIWEGK

SEQ ID NO: 12350 - protein, 398 aa, Methanocaldococcus jannaschii DSM 2661
MSQENWIDLEKKYHLQIYGRLPVVLVEGKGMEVYDIDGKKYLDFLAGIGVNNVGHCHPKVVEAIKKQAETLIHTSNIYYTIPQIKLAKKLVELSGLDRAFFCNSGAEANEGAIKFARKYVSKVLGREGGEIISMYNAFHGRTLTTLAATPKPKYQDGFYPLPPGFKYVPFNDIEALKEAITDKTAAIMIEPVQGEGGIHVADKDYLKAVRDLCDDKNIVLIFDEVQCGMGRTGRMFAFEHYGVEPDILTLAKALGGGVPIGAVVLKEEIAKALSYGDHGTTFGGNPLACSAALASVEVIEELIKDDKVIEKGKYFIRKLENLIEKYNFIKEVRGLGLMIGAELEFNGADIVKKMLEKGFLINCTSDTVLRFLPPLIVEKEHIDALINALDEVFTEIKK

SEQ ID NO: 12351 - protein, 284 aa, Methanocaldococcus jannaschii DSM 2661
MEWMIMKLAEKFEELKNKGEKAFVAFYVGGDPNLEISEKALEVICKHADIVEIGIPFSDPVADGITIQKADVRALNSGMNPLKAFELAKKLNEKAPNVPKVFLTYYNIIFKMGEEEFVKKCKEAGVSGIIVPDLPIEEADSLYNYCKKYGVDLIFLVAPTTPDERLKKILEKCSGFVYVVSVTGITGAREKVAEETKELIKRVKKFSKIPACVGFGISKREHVEEITEIADGAIVGSAIVKIVEKHLDENGQIKDEEKFLKELEEFVKNLKEGTKKKAKVAIKN

SEQ ID NO: 12352 - protein, 279 aa, Methanocaldococcus jannaschii DSM 2661
MYIVETKDLYFRYPDGTAVLKGINFKVKKGEMVSLLGPNGAGKSTLFLHFNGILRPTKGEVLIKGKPIKYDKKSLVEVRKTVGLVFQNPDDQIFAPTVKEDVAFGPLNLGLPKEEVEKRVKEALKAVGMEGFENKPPHHLSGGQKKRVAIAGILAMQPEVIVLDEPTAGLDPVGASKIMKLLYDLNKKGMTIIISTHDVDLVPVYADKVYVMYDGKILKEGTPKEVFSDVETIRKANLRLPRVAHLIEILNKKDNIPIEWGFTIGEVRRNIVNYLKEKC

SEQ ID NO: 12353 - protein, 464 aa, Methanocaldococcus jannaschii DSM 2661
MNKMNIDKNLLEKWDKEYIWHPYTQMKEYRESKNLIIERGEGNYLIDIYGNKYLDAVSSIWCNLFGHSRKEIIEAIKNQADKICHSTLLGCGNVPSILLAKKLVDITPKHLTKVFYSEDGAEAVEIAIKMAYQYYVLRGDKGRTKFISVKEGYHGDTVGAMSVGGSELFHGVFKPLLFKGYHANPPYCYRCKYHNFKDTDERNEKGCEMECLNEMISLIEKHAEEVFCVILEGGIMGSAGMIPYPDGYIEGVAKACKENDVIFILDEVATGFGRTGKMFFCDNEELKKLEKPDILCLGKGLTGGYLPLAATLTTDEIYNQFLGEFGESKQLYHGHTYTGNQLLCSAALATLEIFEKENVIENIQPKIKLFHKELRKLKELEHVGDVRGRGFMVGIELVKDKETKEPYPYGYKAGYRVAEKLLEKGIYMRPIGNVIILVPPLSITEKEIIYLCDALYEAIKEADL

SEQ ID NO: 12354 - protein, 420 aa, Methanocaldococcus jannaschii DSM 2661
MWGENIATADLFANATDIHSIVQALTTLANASDVFFLVVMGVLVFMMQWGFAMLEGGQVRKKNVNNVMMKNMVDWLIGCVAWLFIGGILCSKGFDLSAFIDWWKQILGTNWPNNGLDLASWFFGLVFCATAATIVSGGVAERIKFSAYVLISLIITGLLYPLFVYLGPWGASIVPWHDYAGSLVVHGLGGFLALGAIAALGPRIGRFVDGRPVPILGHNIPMAVFGAFALAIGWYGFNVGSSLALGDISGLVCATTTMAMAGGGIGALIASRNDVLFTANGIVAGLVAICSGTDVVSPIGGLIIGLIAGLQVPIVYKLVEKAGLDDVCGVVPVHGTAGVIGAILTGILGLKIFGGAGGVSLIDQIIGAVFCIIYGTGLGYILAKIVGIALGGLRVSEEEEKMGLDMAEHKMPAYPEETVI

SEQ ID NO: 12355 - protein, 454 aa, Methanocaldococcus jannaschii DSM 2661
MHWGMEMNVEQAIEYVKKNNVKFIRFQFVDILGFPKNVAYPVKAGEKGIEELREIFENGVWFDGSSITGFVGIEESDMLLKPDLSTLSVLPWRPEEKSVARVICDVYKDEKTPFEGDPRSRLKAILEELKKEMNGEYFVGPEPEFFLLKRDPHNPHRWVPADDGGYFDVEPLDDAPDIRRDIVLALENLGFHVEASHHEVAPGQHEVDFKFDNALKTADSVITFKMTIKNIAKKHGLKATFMPKPFFGMNGNGMHCHQSVWFNGEPSFYDPEGPYNGLSETCLSYIAGILSHAKALVAITNPTVNSYKRLVPGYEAPVNIAWANKNRSAIIRVPAARGKATRIEFRAPDPTCNPYLAFACMLAAGLDGIKKKMTAPEPVERNIFKMSEEEKKQLGIESVPANLAAALDELECDEVLQKALGKHIYENYMEIKRAEWDDFRTAVTDWETGKYLIY

SEQ ID NO: 12356 - protein, 418 aa, Methanocaldococcus jannaschii DSM 2661
MESYIQNLFAERIGGKKFGKEDVIYKFEKIKRAKQEAMKRHPDMELIDMGVGEPDEMADPEVIRVLCEEAKKWENRGYADNGIQELKDAVPPYMEKVYGVKDIDPVNEVIHSIGSKPALAYITSAFINPGDVCLMTVPGYPVTATHTKWYGGEVYNLPLLEENDFLPDLESIPEDIKKRAKILYLNYPNNPTGAQATKKFYKEVVDFAFENEVIVVQDAAYGALVYDGKPLSFLSVKDAKEVGVEIHSFSKAFNMTGWRLAFLVGNELIIKAFATVKDNFDSGQFIPIQKAGIYCLQHPEITERVRQKYERRLRKMVKILNEVGFKARMPGGTFYLYVKSPTKANGIEFKTAEDFSQYLIKEKLISTVPWDDAGHYLRLAACFVAKDENGNPTTEEKYEDMVLEEFKRRLEGMDLEFE

SEQ ID NO: 12357 - protein, 463 aa, Methanocaldococcus jannaschii DSM 2661
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIKTIIISK

SEQ ID NO: 12358 - protein, 1102 aa, Methanocaldococcus jannaschii DSM 2661
MKFMCGIIGYIGNDKAPKILLNGLRRLEYRGYDSCGIGVVDNNKLIIKKNVGKVEEVAKKERFLDIDGNIGIGHCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSRWATHGNVCKENAHPHTDCKEEIAVVHNGIISNYKELKDELMKKGHKFKSETDTEVVPHLIEEELKKFKEINEENYIKAVKNAIKKLKGTYALVIINKNFPNLLIGARNESPLILGINDDGYFLGSDITAFLDYTNKAIPLEDGDVVVIKKKENGYEVTIENNGNTVEREMMEINWDISSAEKMGYPHFMLKEIMEQPEVLKVSAKISAEEIKELAKCIKDYDRVYFVAMGTSLHAAMVVEYLFAKLGKLVIACDASEFLNKGVVDDKTLVIGITQSGETYDTLKALRFAKKNKAKTGAIVNVLGSTATREADITVMMGAGIEIAVCATKTYTSQLMILYRLFIEYGKLLGRDMSEYEKEIDKIPNYIKEVLDKKETIKEIANNLKVNNYIFISKGINIASALEGALKFKEITYLHAEGMSGGLLKHGTISLIDENMDTVAIVPPRDSAVFNSILSNIEEVKARGGKVIAITPTEIDGAENILVPEVIEEISPIVYAPAFQLLAYYKAVELGRDVDKPRGLAKSVTVE

SEQ ID NO: 12359 - protein, 127 aa, Methanocaldococcus jannaschii DSM 2661
MDVEDTVKKLNLKFRNIEGERLILAITCDENKNVLMVAFMNEEALKKTLETGYMHYYSTSRKKLWRKGEESGNVQKLIKFYRDCDGDALLFIVEQKGVACHEGYYSCFHYKIEDGELKITGEYYSKR

SEQ ID NO: 12360 - protein, 491 aa, Methanocaldococcus jannaschii DSM 2661
MRRDINNFLFGERMELFEILKQKIKEKEVITPKEMAIIDDNAEFLGIQKILLMENAGKAVYEEIKDIDAEEFIIFCGTGNNGGDGFVVARHLGKGDVILIGKESEIKTYEARENFKILKNLAEFGNIRIREIKWAEEVNDIFERLKNKKAVIIDAMIGTGVKGELREPFKTIVDKINELKQINKNIFVISVDVETGHLESDLTITFHKRKTINKDNAIVKKIGIPKEAEYIVGWGDLKALRKRDSNSHKGQNGKVLIIGGSKDFYGAPILAGLAALKIVDLVGILSVGKVIDKVNHPEFIMYRVEGDYLSSQHVDYTLEIAKKYDVVVLGNGLGANNRTKAFLNEFLAKYDGKVVIDADAIKVIDYNNFEFSENYIFTPHKREFEYMGIDLDNIENIKSTIVLKGKYDIIFNANNLKINKTGNAGLTKGGTGDVLAGLIGALFAVNEAFLSACCGAFINGYAGDLLLKEKGYYYTPLDLIEKIPNVLKIFQ

SEQ ID NO: 12361 - protein, 401 aa, Methanocaldococcus jannaschii DSM 2661
MLSYDYENALKVGEISLEDINKVDFANAYSNLMEKLDNGVVGFRDVIYDENLDKYKSLNGYENVVVIGMGGSILGTMAIYYAISPFNNNAYFIDNSDPEKTLSILKKVDLNESIIYIISKSGNTLETLVNYYLIKKRIEKLNSFKGKLVFITNGGKLKREAEKNNYDIFSIPENVPGRFSVFTAVGLAPLYSLGVDISKILEGAREMDKICQNEDILKNPALLNGVIHYLYDKRGKDISVIMSYVESLKYFGDWYKQLIGESLGKNKHGITPLLSIGAKDQHSLLQLYMDGKKDKIITFMVAKKYRLDEEIEFEDINDEKISCRYSDIIRSQQKATEIALTNNGVPNVRITLDEINEMAMGALLYMYEMQVGFMGELYNINAYNQPAVEEEKKICWRLIKQ

SEQ ID NO: 12362 - protein, 496 aa, Methanocaldococcus jannaschii DSM 2661
MFLKKLIEAKKAYTFDDVLLVPNASWVEPKDTDVSTDLAGLKLNIPIVSAAMDTVTEKEMAIALARLGGLGVIHRNMSIEEQVHQVQAVKKADEVVIKDVITVSPDDTVGEAINVMETYSISGLPVVDNEDKLVGIITHRDVKAIEDKTKKVKDVMTKDVVCAKEDVEEEEALELMYANRVERLPIVDDENRLIGIITLRDILKRRKYPQAARDKKGRLLVAAACGPHDFERAKALIEAEVDAIAIDCAHAHNMRVVENVKKFKEMLEGTDIKLIVGNIATKEAAEDLIKAGADVLKVGIGPGSICTTRVVAGVGVPQLTAVAEVADVAKEHNVPIIADGGIRYSGDIAKAIAAGADAVMLGSLLAGTDEAPGQLMVINGRKYKQYRGMGSLGAMTGGVGAGADRYFQAPAKSHMKHVKLVPEGVEGAVPYKGPVSEVVFQLIGGLRASMGYCGAKNLKEMQEKARFVIITPSGQVESHPHDIIITNEAPNYPLGK

SEQ ID NO: 12363 - protein, 472 aa, Lactococcus lactis subsp. lactis Il1403
MVVGAQATEVDLVVIGSGPGGYVAAIRAAELGKKVTIIEKDNVGGVCLNIGCIPSKALINIGHHYQESLEEEKGENPFGLSVGNVKLNWESAQKWKQDKVVNQLTGGVKMLLKKHKVDVIQGTAEFIDNNTINVEQEDGFQLLQFNDVIISTGSRPIEIPSFPFGGRIIDSTGALSLPEVPKHLIIVGGGVIGSELGGAYRMLGSKITIVEGLDHILNGFDKEMSDIIANRVKSAGSEIFTSAMAKSATQTDKDVTLTFEVDGKEQTVTGDYLLVSVGRRPNTDLIGLNNTDVKLTDRGLIEVDDSYATNVPHIYAIGDVVPGPMLAHKASFQAKVAAAAIAGAEDDVDLHVALPAVAYTTTELATVGETPESVKDRKDVKISKFPFAANGRAISMNDTTGFLRLITETKEGALIGAQIVGPGASDLISGLSLAIENGLTSKDISLTIQPHPTLGEAIMDTAELADGLPIHV

SEQ ID NO: 12364 - protein, 469 aa, Lactococcus lactis subsp. lactis Il1403
MGFMRKADFELYRDADKHYNQVLTTRDFLALGVGTIISTSIFTLPGQVAAQFAGPGVVFSYLLAALVAGFVALAYAEMSTVMPFAGSAYSWISVLFGEGFGWIAGWALLAEYFIAVAFVGSGFSANLQQLLAPLGFHLPKVLANPFGTDGGVVDIISLLVILLSAIIVFRGASDAGRISQILVVLKVAAVIAFIIVGITVIKPANYHPFIPPHNPKTGFGGFSGIWSGVSMIFLAYIGFDSIAANSAEAKKPQKTMPRGIIGSLLIAVVLFAAVTLVLVGMHPYSAYAGNAAPVGWALQQSGYSVLSEVVTAIALAGMFIALLGMVLAGSRLLYAFGRDGLLPKGLGKMNARNLPANGVWTLAIVAIVIGAFFPFAFLAQLISAGTLIAFMFVTLGIYSLRRRQGKDLPEATYKMPFYPVLPALGFIGSLFVFWGLDVQAKLYSGIWFLIGILIYFAYGNRRSRKSEEK

SEQ ID NO: 12365 - protein, 478 aa, Lactococcus lactis subsp. lactis Il1403
MEHKKLKAFPNDFLWGSASAAYQVEGAPFEDGKKASVWDNFVRIPGKTFKGTNGDVAVDHYHRYKEDVALMKELGLKSYRFSIAWTRILPDGRGEVNQAGLKFYEDLIDELIANEIEPIVTIYHWDLPQALEDLYGGWESREIIADFVNYAEVLFNAFKGKVKYWVSLNEQNIFTSQGWSLATHPPGKRDMKLFYQVNHIANLTNAAVINKFHELEMDGQIGPSFAYTPQYAKDSDPLNVLAAENAEELYSHFWMDVYLYGEYPIAAMAYLRENGLAPEFEAGDAELLKSAKPDFLGINYYQTATNAWNPVDGGVGVGSFNTSGKKGTTKESGIPGLHKKIQNPFIDRTNWDWEIDPEGLRIALRRITSRYRIPVMITENGLGEYDKVEDGKIHDDYRIKYLESHVKAIKEAMTDGAKVIGYHTWSYTDLLSWLNGYQKRYGFVYVDQDETMEGSLKRIPKDSYYWYQHLIETNAEEV

SEQ ID NO: 12366 - protein, 493 aa, Lactococcus lactis subsp. lactis Il1403
MSNWETKFLKKGFTFDDVLLIPAESHVLPNEVSMKTKLAKNLTLNIPIISAAMDTVTDSKMAISMARQGGLGVVHKNMSVEEQAEEIHKVKRSESGVITDPFFLTPNHKIEEAENLMATYRISGVPIVDTLENRKLVGIITNRDLRFITDYNQQIKNMMTSENLITAPVGTTLDTAARILQEHKIEKLPLVDEAGKLAGLITIKDIERVIEFPNAAKDEQGRLLVAGAVGVSSDTFERAEALFAAGADAIVIDTAHGHSAGVLRKIREIRNHFPDRTLIAGNIATGEGARALFEAGVDVVKVGIGPGSICTTRVVAGVGVPQITAIYDAANVAREFGKTIIADGGIKYSGDIVKALAAGGDAVMLGSMLAGTDESPGEFEIFQGRKFKTYRGMGSLAAMKKGSKDRYFQGAVNEANKLVPEGIEGRVAYKGTATDIVFQMLGGLKAGMGYTGAADITALHDSAQFIEMSGAGLKESHPHDVQITKEAPNYSVQ

SEQ ID NO: 12367 - protein, 398 aa, Lactococcus lactis subsp. lactis Il1403
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 12368 - protein, 275 aa, Lactococcus lactis subsp. lactis Il1403
MIELTDEILAKVIKKRKKASYKGTYGRLLVIGGNRQYGGAAILVTTSAVYSGAGLVSVALAKENHSALQARLPEAMTLDFDDLIKLREVAKAADVIVIGPGLGLERLDLLTEVLNLLTENQKLVIDGSALTLFAREHLDLPFPENTVFTPHEMELERLSGLKIGQQTKEEVQDFVNQLGAIVVAKSSETRIFAPNRESFILKIGSPAQATGGMGDTLAGMVGGFLAQFHGETEEVVAAATYLHSLIASVLARKTYVVLPSRLIEEIPLFMKKYEC

SEQ ID NO: 12369 - protein, 422 aa, Lactococcus lactis subsp. lactis Il1403 [sequence omitted]

SEQ ID NO: 12370 - protein, 233 aa, Lactococcus lactis subsp. lactis Il1403
MPKLVFARHGESEWNLANLFTGWADVDLSENGTKQAIEAGKLIKEAGIEFDIAYTSVLKRAIKTTNLALEYSDQLWVPVVKSWRLNERHYGGLTGLNKADAAAKHGDEQVHIWRRSYDVLPPAMDHDDKYTAHGDRRYAGLEDSLIPDAENLKVTLERALPFWEDQIAPALKEGKNVFVGAHGNSIRALVKQIKKLSDDEIMDVEIPNFPPLVFEFDDNLNVQNEYYLAPKKA

SEQ ID NO: 12371 - protein, 457 aa, Lactococcus lactis subsp. lactis Il1403
MNTNQNEENKPSQRGLKNRHIQLIAIAGTIGTGLFLGAGKSIHLTGPSIIFVYLIIGALMYILLRAIGEMLYQDPNQHSFLNFVSRYLGEKPGYFIQWSYLLVVVFVAMAELIAIGTYINFWLPDLPIWMTEVFVLVLLTLLNTLNPKFFGETEFWFGMIKIVAIIGLILTAIILIFSHYHTGTDTVSVTNITKGFEFFPNGLSNFFESFQMVMFAFVSMEFIGMTAAETDNPRPTLKKAINQIPIRIVLFYVGALLAIMSIYQWRDIPADKSPFVTIFQLIGIKWAAALVNFVVLTSAASALNSALFSITRNLYSLSKLNNDKILKPFTKFSKAGVPVNALLFTSLLILFTPFISMIPAISNSFVFITSVATNLFLVVYLMTLITYLKYRKSSDFDPKGFVLPAAHIFIPLAIAGFVLIFISLFCFKDTIVPAIGSVIWVLIFGLFTFFKKIKTAE

SEQ ID NO: 12372 - protein, 459 aa, Lactococcus lactis subsp. lactis Il1403
MENLQEKHEAQRGLQNRHIQLIAIAGTIGTGLFLGAGKTIQMTGPSVIFAYILIGIAMFFFLRTIGEMLYNDPSQHSFLNFVTKYSGVRTGYFTQWSYWLVIVFVCISELTAIGTYIQFWLPQVPLWLIEIVMLALLFGLNTLNSRFFGETEFWFAMIKVAAIIGMIVTAIILVAGNFHYSTVLSGKTVHDSASLSNIFDGFQLFPHGAWNFVGALQMVMFAFTSMEFIGMTAAETVNPKKSLPKAINQIPVRILLFYVGALLAIMAIFNWHYIPADKSPFVMVFQLIGIKWAAALINFVVLTSAASALNSSLFSATRNMYSLAQQHDKGRLTPFTKLSKAGIPINALYMATALSLLAPVLTLIPQIKNAFDFAASCTTNLFLVVYFITLYTYWQYRKSEDYNPKGFLTPKPQITVPFIVAIFAIVFASLFFNADTFYPALGAIVWTIFFGLYSHYKKI

SEQ ID NO: 12373 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 12374 - protein, 446 aa, Lactococcus lactis subsp. lactis Il1403
MKIVVIGTNHAGIATANTLIDRYPGHEIVMIDRNSNMSYLGCGTAIWVGRQIEKPDELFYAKAEDFEKKGVKILTETEVSEIDFTNKMIYAKSKTGEKITESYDKLVLATGSRPIIPNLPGKDLKGIHFLKLFQEGQAIDEEFAKNDVKRIAVIGAGYIGTEIAEAAKRRGKEVLLFDAESTSLASYYDEEFAKGMDENLAQHGIELHFGELAQEFKANEKGHVSQIVTNKSTYDVDLVINCIGFTANSALAGEHLETFKNGAIKVDKHQQSSDPDVSAVGDVATIYSNALQDFTYIALASNAVRSGIVAGHNIGGKSIESVGVQGSNGISIFGYNMTSTGLSVKAAKKIGLEVSFSDFEDKQKAWFLHENNDSVKIRIVYETKNRRIIGAQLASKSEIIAGNINMFSLAIQEKKTIDELALLDLFFLPHFNSPYNYMTVAALNAK

SEQ ID NO: 12375 - protein, 478 aa, Lactococcus lactis subsp. lactis Il1403
MTLKKDFLWGGAVAAHQLEGGWNAGGKGVSVADVMTAGSNGVERKITDGVIEGENYPNHEAIDFYHRYKEDIALFDELGLNCFRTSIAWTRIFPNGDEAEPNEEGLQFYDDLFDECLKHGIEPVITLSHFELPYHLVTEYGGFRNRKLIDFFVHFSEVVMNRYKDKVKYWMTFNEINNQANYLRDFAPFTNSGLKFPEGASEKEREEMMYQAAHYELVASAKVVALGHKINPDFQIGCMIAMCPIYPATCKPEDMMASTVAMQRRYWFADVHVRGHYPSYLKAYFDRKEFKLDILDDDLKALEEGKVDYIGFSYYMSFAIKDHGKAPTFDYNEDKDLVKNEYVKASEWGWQIDPLGLRYAMNWFYERYEKPLFIVENGFGAVDEVEADGSIHDPYRVDYLKAHIEAMKNAVDYDGVDLMGYTPWGFIDLVSAGTGEMKKRYGVIYVDKDNEGNGTLERSKKDSFTWYQKVIATNGEEL

SEQ ID NO: 12376 - protein, 310 aa, Lactococcus lactis subsp. lactis Il1403
MTKIYDNITELIGQTPIVKLQHVPAESADVYVKLEAFNPGGSVKDRIALAMIRAAEADGHLKPGGTIVEPTSGNTGIGLAFVGSALGYKVVIVMPESFSLERRKLIQAYGAQLVLTPASGGMKAAIAKAKELSETEGYFLAMQFENPANPEIHEKTTGAEIIDAFGPTGLDAFVAGAGTGGTITGVSHALKKANPTIKTYVVEADESAILSGEAAGPHKIQGISAGFIPGNLDTKSYDEIIRVKGDDAILTARHLGGKEGFLVGISSGAAIYAALEVAKKLGKGKKVLAIAPDNGERYLSTALYDFESEK

SEQ ID NO: 12377 - protein, 433 aa, Lactococcus lactis subsp. lactis Il1403
MYKMWQTRVLISTAFVYIGYYIIRLIFTVQQNDISKAYGFSMGQIGTILSMFGIGYGISKLIMGTLADRANPNRYVATGLIVSAIINALYGTTQSFGMIVFLMLLNSVMQGMGAAACQRLVGLWFGRKAKGSIMARGTAFSIWSSAHNAGAFMCVAVINLSAFFFGASLQWSFWTASIVSIVIAIIVLFLGSDRPTTKGLPTIEEYSGDKVVIKDGEIVEGDVSNDNVFKIFFEYIVKNKLVWAVILTSLSIYVVRYGIMSWIPNYLVNIKGFDNSTAKWLTGIFELAAVPGVIIIGFITDLLKGRRAIMVLVSLIAMLACLITYFAATNHTLIIIVLLIMGTFIYAPATIVGLMVNEAVPKFANGMSTGTMGFCQYIIGEVTATLVIGWLVQAYGWSAGNIIVYIFAGIAILASIYILVHQNRLYKKIDDAG

SEQ ID NO: 12378 - protein, 151 aa, Lactococcus lactis subsp. lactis Il1403
MKEYRQNVAAIILNKENKIWLGKRADGMSWGFPQGGIEAGEKPETAIIRELSEEIGTKEFEIIGQYPGTLKYDFPKEMKFPTWTYAGQEQHYFLVRLHEEAKINLESHPEEIEFSTYQFLGLSEIRKMDFGFKNDVYHQALDYFSKIIEKN

SEQ ID NO: 12379 - protein, 398 aa, Lactococcus lactis subsp. lactis Il1403
MTYHIKTIGNNIDQIALDEIGEGFLVNQVSEAESDAFICRAQPFHDYEFSKALLAIGRAGAGFNNIPIEKCASKGIVVFNAPGGNANAVKELVLSMMIFGTRNLKPANKWLTGQKGDDNTIDGAVEHGKKAFSGSEISGKTLGVIGLGNIGSKVANDAQRLGMRVIGYDPYLSIEHAWNLSHHVKRVNDLAEIFEKADYITVHTPATDETTKMLNWKNLSKCKKGVILLNYARDEITDKEAVLKAIDEGIVRFFGTDFGSEKFYHHPQVFLTPHLGGSTAEASLNCTRMALDSVQTYLKTGEIINSVNFPRVLQELNTPYRVTLINKNVPNVVAQISLAVAAENINIANIVNRGQGDYAYTLLDLDEKDEGKLAALVSRFEAADNIIRVRLIENQSLV

SEQ ID NO: 12380 - protein, 472 aa, Lactococcus lactis subsp. lactis Il1403
MAQANFGVVGMAVMGKNLALNVESRGYTVAIYNRTTSKTEEVYKEHQDKNLVLTKTLEEFVGSLEKPRRIMLMVQAGAATDATIKSLLPLLDKGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRVLGLSNAEIQAIFEEWNEGELDSYLIEITKEVLKRKDDEGEGYIVDKILDKAGNKGTGKWTSESALDLGVPLPLITESVFARYISTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYTED

SEQ ID NO: 12381 - protein, 433 aa, Lactococcus lactis subsp. lactis Il1403 [sequence omitted]

SEQ ID NO: 12382 - protein, 328 aa, Lactococcus lactis subsp. lactis Il1403
MKAIGTIDSSKNFIDFEIEKPILRPHDLLIKVEAISINPVDTKVRKGIKGNLAEPKILGWDGLGTVVELGSETKLFKVGDKVFWAGDVTRSGSNAEFQAVDERIVGFAPKNLTKEKAVAMPLTSLTAYELLFEKLEVTDKSKGKSLLIINGAGGVGSVAIQMAKNAGLTVIATASNPQAIEWVKNFGADYTVNHHEKLVPQVHELGFKFVDYILILNAVVEHMPAVNELIAPQGSIANIVEPGQAINLDQLAHKSARFNFEWMFTKVVSNTSDLQSQHDILNKVSEWLDNDVLKSTMTQNLGPITAENVKKAHELIEENHTIGKIILS

SEQ ID NO: 12383 - protein, 306 aa, Lactococcus lactis subsp. lactis Il1403
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQIIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTKAYDGVIDVTSDEALETARKIGKSEGFLVGISSGAAIWAAYELAKKLGKGQKVLALCADNGERYLSTELYDY

SEQ ID NO: 12384 - protein, 377 aa, Lactococcus lactis subsp. lactis Il1403
MTNLFENYGRLPFSLIKGEDQYLFDDRGNKYLDFTSGIGVMNLGYSFEKGKVAVKAQLDSLSHLSNLYQNPLQEDVAEKLSQNHSYKAFFCNSGTEANEAALKLTHLIKKDQKILAFTDGFHGRTFGAMSATMQEKIQAGFSPLLPNFVASPFNDVVALEQILEKEKIGAIIFEIIQGEGGVLPISPDFVEALKSCQQKGILLIIDEIQTGIGRTGKLFAFEHFDFEPDIFTLAKALANGIPTGAMLAKNKYASYFSAGKHGSTFGGNPLAMASANEVLKEIDSDFLEKVTDKGIFFLKLLTEKLSVKATVKSIRGLGLMIGIQLTDEKKVPEVLALLRENGLLALSAGHDVIRLLPPLVMTKVELQKGAELLEKIL

SEQ ID NO: 12385 - protein, 446 aa, Lactococcus lactis subsp. lactis Il1403
METNQSLKKKMAARHITMIALGGAIGAGLFKGSSSAIAAAGPSVLIAYFIGGIVLYFVMKSLEKLVLSSKDPHGLSGLVQPYLGNHTADFTDWVYWSMWMINIIAEAVAAASFLQLWFANVPTWVFVLIIALLTSLINLFSVALFAETEYWLAFIKISVVILLIIFGVFLVAKQIFDTNLVTTFSGMTAHGGFAPHGFKGVINSLLIVIYSYGGSELIAITVSETEDPKRAIPKAIRGVIGRIISFYIIPMFLLLVIYNWQTLATSSMSPFVMVFNKMHIPFAGDIVNLIIILALFSSINSGIYASSRLLYFRLKNRQGKMAQRMAHLNKHHVPQRAVIFCSGTLYIGVVLSYFVGDRLFNYLAGSLSYTVLAVWILISLAGFGLSLKTKSLSGRTMSLLALIALFLILIGILFTNPIGVTVFTAILYFIIFISYQKKNDSVSNLN

SEQ ID NO: 12386 - protein, 453 aa, Lactococcus lactis subsp. lactis Il1403
MENKMPKDFFWGNSTSSMQTEGGWNEGGKGPSVYDVNTVGRSAKDWQVTNDNYHHYSQDLDLMKEMNMNMYRFQISWSRIVPDGDGEFNEEGIAFYNRLIDDLLARGIEPMICLYHFDMPLNLAEKYNGFLSRKVKEAFVRFGQEMMKRFADKVKYWIVFNEHNLYFADGFEHYSGVLKKELTLSDMYTVFHHTMLAHCELTQFLHENFEAKIGGMLATTEIYPATFSPKDNLYLRKFDEFYNRNLCDVYAFGHYSHEVMTYVKNQNIQMDFQKGDEEILKNGISDFISFSYYRSILLDASQLTENDAPNSYLTKGMKLNPLLEHNQWDWSIDPEGFRRILSRLYNEFGLPVFPIENGIGQSEIWDGKTKIADDLRISYHQKHLEAMKKAIFTDGVEVMGYLGWGLIDIPASSGAIDKRYGAVYVDSKSHKRIPKKSFHWFKNVFASNGDHLD

SEQ ID NO: 12387 - protein, 435 aa, Lactococcus lactis subsp. lactis Il1403
MFDYIIIGAGPGGLGLAYRLKTKDNKIGIIENDKWGGTCPNYGCDPTKMMMAVVEAKSRVEQLKGQGISGELNIDWKGLKSRKLNITDPYEKSTFTGLKNAGIETIYGSAAFNDQGKLEVEGKTYQAKTYIIATGSRPRLLDIDGKEFLKTSNDFLALEEFPAQISFLGSGPISLELAQIAKAAGSDVTIISRKKARVAHFDEEMGQEFINYLKAQGIKFIEDISVDKVEKVADGFLLTDGTDFEHKTDLVIAGVGRQPNSDKLNLEKVGVETDAKGIKVNEYLQTSNSKIYAMGDVLSKNQPHLTPVSSFEGAYLGENLVKDEPQKIAYPAIPTIIFGTAKLAEVGHLAGEGIHTKTLDLSSWYTYKRINDPLAKLKVALNEKREIVGASTVSSVADEVINLINILIQQKMTLADVEKMIFTYPTVASDLEYFY

SEQ ID NO: 12388 - protein, 250 aa, Lactococcus lactis subsp. lactis Il1403
MIKITNISKTFSGNQVLNDISLEIEEGDVVALIGASGAGKSTFLRALNDLERPDSGQIEIDDLKIDYSTITKQEVLELRRKTGMVFQQFNLFERRTALENVMEGLIQVKKLSKAQAKEIAEAELDKVGLTDRKDYYPKFLSGGQKQRVGIARALAMQPKLLLLDEPTSALDPELVGEVQEVILNAAQNKQTMVLVSHEMDFVYNVATKVLFLEQGKIIEAGTPQEVFYSPKNPRTREFLSRHVKNLEVNN

SEQ ID NO: 12389 - protein, 495 aa, Lactococcus lactis subsp. lactis Il1403
MGEKIMPHLYQDDSLTLHTDLYQINMMQTYFELGRHQRQAVFEVFFREMPFKNGYAVFAGLERMVDYLKNLKFSETDIAYLRELDYPEDFLNYLKELRFTGTVRAMQEGQLAFANEPLVQVEGSLAECQLVETAILNIINFQTLIATKAARIKSVIGDDPLLEFGTRRAQEMDAAIWGTRAAIIGGADATSNVRAAKIFGLKASGTHAHALVQSYGNDYEAFKAYAQTHKDCVFLVDTYDTLRVGVPSAIKVAREFGDKINFQGVRIDSGDMAYISKKVRQQLDEAGFTDAKIYASNDLDENTILSLKMQKAKIDVWGVGTKLITAYDQPALGAVYKLVSMEDESGQMQDTIKLSSNAEKVSTPGKKQVWRITKKADGKSEGDYITFSDERPDVAEEIYMFHPLYTYINKNVRDFNANPLLKDIFVDGELIYGLPSLQEIKEFARENLEELWDEYKRDLNPQPYPVDLSQELWNHKMRLISQVRTTVSMTRLDDE

SEQ ID NO: 12390 - protein, 252 aa, Lactococcus lactis subsp. lactis Il1403
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 12391 - protein, 329 aa, Lactococcus lactis subsp. lactis Il1403
MNNLNSVFDYEDIQLIPNKCVINSRLEADTSVKLGNFTFKLPVVPANMQTIIDDKIAEMLAKEGYFYIMHRFEAENRAAFIKKMHQQGLIASISVGVKADEHAFIREISADALIPEFITIDIAHGHADSVIKTIQLIKRLMPQTFVIAGNVGTPEAVRELENAGADATKVGIGPGKVCITKVKTGFGTGGWQLAAVKWCAKAASKPVIADGGIRTHGDIAKSIRMGATMVMVGSLFAAHEESPGQTVERDGQLFKEYFGSASEYQKGEHKNVEGKKILLPHKGSLKDTLKEMEEDLQSSISYAGGRDLSALTKVDYVVVKNSIWNGDAI

SEQ ID NO: 12392 - protein, 212 aa, Lactococcus lactis subsp. lactis Il1403
MRPDFHKQELIPVIVQDYQTNQVLMLAYTNEVAFEKMLETGETWFWSRSRQKLWHKGEESGHFQKIKGMRLDCDQDTLLVFVEQIGNACHTGTYSCFYDELIPFDDSDIFSELEKQIIDRKLHPVEKSYTNYLLGEGIDKVLKKVGEEASEVIIASKNSDKGELLGEIDDLLYHLFVLMNQQGISLEEVRQKAKERHQLEGNKKEFHTRTAD

SEQ ID NO: 12393 - protein, 479 aa, Lactococcus lactis subsp. lactis Il1403
MADPNGFLNYPRNDNPYRELAERIKDFAELQVPLSTEERQKQAARCMHCDVPFCHQGIFYGGKRAVSGCPNDNHIPEWNDLIYRGLQRKAYERLILTNPFPEFTGRVCPAPCEKSCAEALNGAGVTIKDNERFLGDLGNDEGWVAEIGKAAEPTGYKIAIIGSGPAGLSAAWRLNQLGHSVTVFEKSDRLGGLLMYGIPNMKLDKKVVQKRIDLMTELGVTFVTNTEIGKTISYEDLSVNFDRIILAIGAGIPRDLNISGREAVGIRFAIDFLTETTKTVLEEGEDNISQSLKGKKVVVIGGGDTGNDCIGTAVRLGAASVSQLEITPSLPTDRLDNNPWPEWPMTLRAGYGQKEAEFVGNTDLITYQMTATAFQTNAEGQLTGLKVAKVGPDFKALEGTEQVIEADLVLLAMGFVGTDTGLLDKFGIQEIYDDYRTNNDKVLVAGDARRGPSLVIWAIREGRKTAEIVDEQLIKVATA

SEQ ID NO: 12394 - protein, 502 aa, Lactococcus lactis subsp. lactis Il1403
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFADGADAISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDIKLIVALTESGNTARLISKHRPNADILAITFDEKVERGLMINWGVIPTMTEKPSSTDDMFEVAEKVALASGLVESGDNIIIVAGVPVGTGRTNTMRIRTVK

SEQ ID NO: 12395 - protein, 478 aa, Lactococcus lactis subsp. lactis Il1403
MTFKTDFLWGGATAANQLEGAYDIDGKGLSVADAMPGGKERLAILASPEFDWTIDIEHFTYPNHDGIDHYHHFKEDIALFAEMGFKAYRFSVAWSRIFPMGDETTPNEKGLLFYDQLIDECLKYGIEPVVTISHYEMPLNLAKTYGGWKNRELIEFYVRFAKVLLERYQDKVKYWMTFNEINSATFFSGLSQGLVPSNGGDDKTNVFKAWHNQFVASAQAVKFGHDLNKSLQIGCMSIYSTTYSFDANPVNQLATQESIQEFNYFCNDVQVRGAYPAFTNRLHRKHGVNADALEISEEDLKIIKEGTVDYIGFSYYMSTVESKTGEGVQASGNMVLGGVKNPFLKESEWGWAVDPDGLCYALNDLYGRYQVPLFIVENGLGAIDKVQEDGTIQDDYRIDYLKKHIQSMNEAVEDGVDLMGYTPWGCIDLVSASTGEMSKRYGFIYVDLDDEGKGTKKRSKKKSFDWYKEVIASNATNL

SEQ ID NO: 12396 - protein, 475 aa, Lactococcus lactis subsp. lactis Il1403
MELKFQENFLWGAATSGPQTEGRFKKQHDNVFDYDFDHYQERFWGGIGPDTASNFFNDFREDIKLMKAAGLKSIRTSIQWSRLIDDLEKNTVNEKAVDFYNAVINEFIAQGIRPMINLNHFDLPVELLKTYGGWESPHVVDLYAGFAAKCFAEFSDRVSDWFTFNEPMVVVECAYLLGFHYPDIVDGKKAVQVAYHLQLASSLAIEQYRKINKNPEGRIGIILNLTPSYPAAEKIEDLKAAEMADLWQNRLFLDASIKGEFPEELVSLLQEENVLWQSEAEDLKRIKENKVDLLGVNYYHPSRVQEPEYSSDSLAQDWRPDKYYASFNKRGVRMNADRGWEIHPQTIYEIAKRIQEDYGNISWFISENGMGVENEEHFKDEEGQIQDDYRIIFTTEHLFWLHKAIQEGSNCFGYHVWTPIDCWSWRNSYKNRYGLISLNIHTQVKTLKKSAYWYKNLTDSSLLQVPDSILEKYNQ

SEQ ID NO: 12397 - protein, 433 aa, Lactococcus lactis subsp. lactis Il1403
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 12398 - protein, 180 aa, Lactococcus lactis subsp. lactis Il1403
MHPHLKEVLFTREQIAERVKELAEVVSRDYEGKNPLVVGILKGSIMFTVDLLKELSIDAEVDFMDVTSYGYGISSSGEVRILKDLSTVAHGRDILIVEDIIDTGNTLLYLKKLLTGRQAHSVKIISLLDKPSGRKVDIDADYVGFEVPDAFIVGYGIDYAERYRQLPYIGIFNEEFLIKD

SEQ ID NO: 12399 - protein, 345 aa, Lactococcus lactis subsp. lactis Il1403
MTNTNKKTILVTGGSGYIAMFIMIALLKKGYRVRATLRTMSRQEEVKKMMAQGGISDFTDLDFVQTDLTKEEGWSQAMTGVDSVIHVSSPTPLQRPDADDLMVKMAVDGVKFVMKAAKEAGVERVVLTSASGAVLAGHKDHPEIFTERDWTNLDAPINAYQRSKTMAEMEFWKLAEAYGIEGASVLPTAVMGPILGNDFSHSSAAIKNMFEGKMPRLLNLAFDYVDVRDVADLHLLALEKKEAIGQRFIATSGQNITYKKQAEFLKKEFGTKAKKVSTQVIPDFLVKILARFDKSLAMPATFLGQNTACSNEKSVKLLGWKPRSGEAAIIQTAQTMLDLGVIKVD

SEQ ID NO: 12400 - protein, 260 aa, Lactococcus lactis subsp. lactis Il1403
MKLNKIKVIVAGFRGKMGATAVQMILNAQNFELMALLGKKEEVSEAFGVPVFSRKEDLIGFDADIWLDLTAPEAAYKNTRFALENGFRPVVGTTGFTDDEVADLIKFSREKELGGLIAPNFALGAVLLMQFSKQAVKYFPDVEIIELHHDGKKDAPSGTAVKTAELMSEERLAHHQGAVDEKEALAGARGADLEGMRIHSVRLPGLVAHQEVIFGSKGEGLTLRHDSYDRSSFMTGIALGIRKVMTVSELKYGLEHFLDL

SEQ ID NO: 12401 - protein, 477 aa, Lactococcus lactis subsp. lactis Il1403
MPFSKDFLWGGATAANQCEGGYNQGGRGLANVDLVPHGKDRFPIITGEMKHLEFDEEHFYPAKEAIDMYHHWKEDLALFAEMGFKTYRMSIAWTRIFPKGDEQEPNEEGLQFYEDIFRECQRLGIEPLVTITHFDCPVHLIKEYGGWRNRKMVGFYENLARAIFTRYKGLVRYWLTFNEINMLLHAPFMGAGLVFEEGENKEQAKYLAAHHELLASALATKIGHEVDPENKIGCMLAAGDYYPFDCNPENVFEAQKQNHDNLFFIDVQSRGKYPNYLLKRLEREEITLPIEKGDLEILAENTVDFISFSYYASRVAKVKDEDADKSAGNIFESVKNPYLEASEWGWQIDPLGLRITMNSIYDRYQKPLFIVENGLGAVDKPDENGFVADDYRIDYMAAHIKEMKKAVELDGVELLGYTSWGCIDLVSAGTGEMSKRYGFIYVDRDDYGKGSLKRTPKKSFNWYKKVIASNGEDLTNE

SEQ ID NO: 12402 - protein, 391 aa, Lactococcus lactis subsp. lactis Il1403
MPNQLTDHVTLRHGATLNNRIVMSPMQTHSGLKGGFASDDTIQYYSARSRAAGMLITEFHYVSENGGPAYVPGYPEQLGAYSDAHLEGLRKTVQALKKDGNKAILQIHHAGRAAVGRHVNGLDVVAPSAIDFSFLDYPVRELTITEIDDIILDFGKATKRAIDAGFDGVEIHGANHYLIQQFFSKLSNLRTDKWGGSLNKRMAFPLAVVKEVKAIVDEYAPKGFIIGYRISPEELHGKNVGYDYTEALTLISEVIKYELDYIHLSLWAGYNSKPENSEKSYAELFKEILDDKTKLLIVGGIFGEDTATDAIENYADLIAVARGTLIDPNFAKKVTEGKGDTILHKISPETVEYSHLTPGLLEAFSREDSLGLPPLPGGETIRHLHTGKYDI

SEQ ID NO: 12403 - protein, 473 aa, Lactococcus lactis subsp. lactis Il1403
MNKFFKLEENGTTVGREIMAGLTTFFAMSYILFVNPQVLGTTGMPVQAVFLATILASIVGTLAIALIANVPYALAPGMGLNAFFAYTVVLSLGYTWQEALAMVFICGIINIIITFTSIRKAIILGIPESLQHAIGGGIGIFIAYIGIKNAGILRFIADPGTYVNNHGTITANSSIVPELVTFNNPGVLVALVGIVVTMFFVIRKWRAGILLSILVTTILALLTGVVKVDVNTLFAENNLGTAINQMGTTFGAAFGPKGFGSLFSDSSRYIEVLMTVLAFSLTSIFDPIGTFIGTGRATGIFTDEDLKDMETSHGFSSKMDKALFADMIATPIGAIFGTSNTTVYVESAAGIGAGGRTGLASVVTAIMFAVSSLFLPLLAIVPTQATAPILIIVGMMMLGSFKEIKWGDLTEAIPAFFASVFMGLAYSISYGIAAGFITYILVKLFTGKVKEVKPVIWVVALLFLINFAVLAVL

SEQ ID NO: 12404 - protein, 279 aa, Lactococcus lactis subsp. lactis Il1403
MKIAYLGPRGSFCSVVAETAFVSEELFAYDSILDVIEAYDEGKCDFALVPIENSTEGTVNMSIDKIFHDSKATVVAEFVLPISQNLLALSKEGKIEHIYSHPQALAQTRNYLREHYPQAKVEITDSTSAAAEFVKNHPDLPIAAVANSYAAKMYDLEIVAKNIQDLAGNSTRFWLLGKEKKSFDLLKTGEKVSLALTLPDNLPGALHKAISVFAWRDIDMTKIESRPLRTRLGQYFFNIDLVNNEKNNLKIPYALEELSGLGVKVRLLGNYAVYSLGEG

SEQ ID NO: 12405 - protein, 247 aa, Lactococcus lactis subsp. lactis Il1403
MGINTQIEVTDLHKSFGKNEVLKGITTKFEKGDVVCIIGPSGSGKSTFLRALNGLETATSGDIIIDGFNLTDKNTNLNLVRQNVGMVFQHFNLFPNMTVMQNITYAPVELKKMSKDDADKKAIQLLETVGLLDKKDAMPEMLSGGQKQRVAIARALAMNPDVMLFDEPTSALDPEMVGDVLAVMQKLAEEGMTMLIVTHEMGFARKVANRVIFTDGGVILEDGTPEELFDSPKHPRLQDFLSKVLNA

SEQ ID NO: 12406 - protein, 244 aa, Lactococcus lactis subsp. lactis Il1403
MNEYLIEIKNLHKYFGKNEVLKGLDIQIKKGEVVVMIGPSGSGKSTFLRTMNLLEKPTDGQVYFEGVNIADKSVDVFKHREKMGMVFQQFNLFPNMTVLENLCLAPVKTGKMTKEEAKKTAEDLLQRVGLSDKAEAYPQALSGGQQQRVAIARALAMNPDVMLFDEPTSALDPEMVGEVLAVMQELAKEGMTMVVVTHEMGFAKTVADRVLFMADGTIVEQGKPAQVFDSPKEKRTQDFLAKVL

SEQ ID NO: 12407 - protein, 449 aa, Lactococcus lactis subsp. lactis Il1403
MENSTGLKSSLKTRHIVMLSLGGAIGSGLFLGSGKVIAQAGPSVLLSYILAGLTLYVVMYGVGKMVIHQDEHKAGMAGVVAPFIGDHWAHFADWVYWATWMAVLIAEEAGVSTFLAMLIPGVPLWVFALIVAVLGTAINLWSVRAFAETEYWLAFIKVAVILILIALGIYLLVINDAHLGFVADTAQKVSTKSTAPSFAPNGFSGFLTSLLVVIFSFGGSELAAITVAETENPKVAIPRAIRGVLIRIISFYVIPIFLFLHLLPWSEVLNPDAASPFATIFARVGIPHADKIVLVIIVIAIFSAVNSAIYATSRSLYSRIQGSNSYVGQRLGKLSKNQVPTNAILVSSFVLFIGVLLSAILGDGFWQFVAGSISFTISIVWILLLVAALVLYFKHKEVTNWFVKLATLVVLIALTIIFIMQIVTNPWTLSVFALVICLLSYFTYRKKKA

SEQ ID NO: 12408 - protein, 395 aa, Lactococcus lactis subsp. lactis Il1403 [sequence omitted]

SEQ ID NO: 12409 - protein, 216 aa, Lactococcus lactis subsp. lactis Il1403
MKNKIAPSILSADFGNFARDVKRLESAGADLVHIDVMDGHFVDNLTFGAGVVSALRVQTHLFFDVHMMVENPEKYVEDFAKAGADSMSIHVEATHHIHGALQKIKNAGMKASVVINPGTPVEAIKTVLPLVDMVLVMTVNPGFGGQKFIPEMMDKVRELAQIRTDKKLDFEIEVDGGIDDQTIKVAKAAGANVFVAGSFIFNGEVEKNIEKLRVNL

SEQ ID NO: 12410 - protein, 287 aa, Lactococcus lactis subsp. lactis Il1403
MTYIPNPTRYDHMIYRPAGNSGLLLPALSLGLWHNFGSVDDFENARDMIHTAFDLGITHFDLANNYGPEPGSAERNFGRILKEDFQKLRDELIISTKAGYPMWPGPYGNWGSKKSLLASLDQSLERLGLDYVDIFYSHRPDPNTPIEETMGALKSALDSGKALYVGLSNYSAKETEAAVLAAEKLGFKLLIHQPRYSMLDRWIEDDLQETLTEAGIGIIAFKPLYQGLLTEKYLHGIPEDSRMRDPHYATLHDDSLTKKRLEQVQALNDLAQSRGQSLAQMALAWVL

SEQ ID NO: 12411 - protein, 377 aa, Lactococcus lactis subsp. lactis Il1403
MNFSEAMATKYKVREILHNGAYHGAADEPLVYVMDGIARFINQETLEVVNGDKISKVIGERIFINTGATPVIPEISGIQESKNVITSEGAMELSELPKKLVIIGAGYIGLEFAGMFNKFGSKVTILEPHSTFLPKEDDDISREIFKDLKASGVEIHLGVKVEKITDSEVLAGGQTYSADKILVATGRRPNITDLNLEKAGVELSESGYIKVDDDLKTSTENIWALGDVRGGGQFYYLSTDDFRIVNNQLFGDHSRKLSDRTLVPYSVFISPTLSRIGLDEKQAKKAGVNYHLFKMAAAPIVKSKVVQDTRGILKALVDPKTDEILGATLYHEDSHEVINLVSLAMKMHTPYQILRDQIFTHPTMGEGLNDLFQNEVK

SEQ ID NO: 12412 - protein, 453 aa, Lactococcus lactis subsp. lactis Il1403
MAKKKSSFVCQNCGYKSAKYLGRCPNCGEWSSFVEEVEVQEVKNQRVSMTGERSKPLKLDEVELFDTPRIETDLDEFNRVLGGGVVPGSLVLIGGDPGIGKSTLLLQVSTQLASRGRVLYVSGEESAQQIKLRAERLGDIDRDFYLYAETNMQSIRAEVERLKPNFLIIDSIQTIMTPEIQSTQGSVSQVREVTGELMQIAKTNDIATFIVGHVTKEGQLAGPRMLEHMVDTVLYFEGERNNTFRILRAVKNRFGSTNEIGIFEMQGHGLVEVTNPSEVFLEERLEGSTGSAIVCALEGTRPILVEIQALTTPTMFGNAKRTTSGLDFNRVSLIMAVLEKRTGLLMQNQDAYLKSAGGVKLDEPAIDLAVAVAVASSYKELPTDARECFIGEIGLTGEIRRVTRIEQRLNEAAKLGFKKVYAPKNSIVGIDIPEQIQVIGVTTLTECLKLVFG

SEQ ID NO: 12413 - protein, 215 aa, Lactococcus lactis subsp. lactis Il1403
MNLLIMGLPGAGKGTQAEFIVKNYGVNHISTGDMFRAAMKNETEMGKLAKSFIDKGELVPDEVTNGIVKERLAQDDIKASGFLLDGYPRTIDQAHALDTMLEELGIKLDAVVNIVVNPDILVDRLSGRYICRNCGATYHKIFNPTKVEGVCDVCGSHDLYQRADDVPETVKNRLDVNIKESAPIIEHYTELGLVKNIEGEQEISQVTEDIKKVLG

SEQ ID NO: 12414 - protein, 443 aa, Lactococcus lactis subsp. lactis Il1403
MKIVIVGSSHAGICAGLRALEEYPEAEITLYDKRNQVSFVSQGIISYLAGQKSVLNQSSYSSVEELKAAGLNMQMETVVEEIDTKNKRLFYRRVNSKKTKLALYDKLIFATGSYPAMTSVPFDKKSKLYFLKSMDDAIKTDEFLKTAKNIAVIGGGMTGVEVARIAQERGIQTTLIHRNKNLLNDYLDEPASHLLESWMNAEGTRLLLNTEVTEIGFDEENTIIQTANGQKIPVDGVIFTIGFRPNSYLLNQQVELGDSGAVIVDEYMQTSCPDVFAVGDVSTTYVNLLEKSYYLPHASDAVRDGEIAAINLLAPRQKINSSQGTYHVPMNNLVMAMTGITIRQAVDAGYDADAVHLLNEHLDGYSPSNIWMIYERRTHQILGLQCIGKTSDMAEYVNIFSLAIQQKLKIEDIEFTDFYFEHGYKDPRGLNRILARLVRENER

SEQ ID NO: 12415 - protein, 448 aa, Lactococcus lactis subsp. lactis Il1403
MAHIKFDYSKLTPFVAENELDEIQWQIDGAAKLLHEGKGAGSDYIGWLDLPEDYDKEEFARIQKAAKKIQSDSEVLIVIGIGGSYLGARAAIDFLSNSFVNLQTAEERKAPRILYAGNSISSSYLADLVDYVADKDFSVNVISKSGTTTEPAIAFRVFEEMLVKKYGREEANKRIYATTDKEKGAVKVNADANNWETFVVPDSVGGRFSVLTAVGLLPIAASGADITALMEGANAARKEYTSTNVHENDAYAYAALRNILYRKGKFSEILINYEPSLQYFSEWWKQLAGESEGKDQKGIYPTSANFSTDLHSLGQWIQEGTRTVFETAIRIEKPRKNINIPELDADLDGLGYLQGKDVDFVNKKAADGVLLAHTDGNVPNMIVTLPEQDEFTLGYAIYFFELAIGVSGYLNGINPFNQPGVEAYKKNMFALLGKPGFEELSKELNDRL

SEQ ID NO: 12416 - protein, 302 aa, Lactococcus lactis subsp. lactis Il1403
MMKFGMIGLGKMGMNLVKNAVDHEIEVVAYDLNTKAVEEAKDYSDKITAVSTIENLLTELPASKIVWLMLPAGTPTNSTIEMLSEKLSAGDILIDGGNSNYKDNLEQNKLLTEKGIKFFDVGTSGGMAGARQGGNFMIGGDDEKSWTIIEPIFKAISMEEGYLYTGKLGSGHYLKMIHNGIEYGMMQAIAEGFEILEESPFDYDYEAVAKLWNHGSVIRSWLMELAQEQFSKDPKLDQIIGHVQSSGEGKWTVEESLDLGVPAPVIALSLMMRQRSLQEDTMTGKVVAALRNGFGGHDVEQK

SEQ ID NO: 12417 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 12418 - protein, 446 aa, Lactococcus lactis subsp. lactis Il1403
MTITAADIRRDVKEKDIKFLRLMFTDILGTLKNVEVPATDEQLDKLFENKMMFDGSSIEGFVRINESDMYLYPDLDTWIVFPWGDEYGKVAGVICDVYTPEGEPFAGDPRGVLKRNLKSMEKLGFKSFNLGPEPEFFLFKLNENDEPTLEVNDKGGYFDLAPTDLAGNTRREIVNVLTDLGFEVEASHHEVAIGQHEIDFKYANALKACDNIQIFKLVVKTIARKHGLHATFMAKPVHGINGSGMHCNMSLFTEDGANAFADPTGDMGLSDVAHSFIAGLLKHAYNFTAITNPTVNSYKRLVPGYEAPVYVAWAGRNRSPLIRVPASRGLSTRVELRAVDPTANPYLALAVLLAAGLDGVEHKLEAPEAIESNIYVMTEEERKAHGITDLPSTLHNAVKALPEDTIVTEALGEHVLVNFVEAKRIEWASYAQFVSQWEIDNYLELY

SEQ ID NO: 12419 - protein, 293 aa, Lactococcus lactis subsp. lactis Il1403
MSKIAFIGTGVMGAAMAGHLMDAGHDLIVYNRTKSKTDGLVARGATYAENPQKAAAQAEFMITIVGYPKDVREVYFGAEGIFKNDCSGKVLIDMTTTEPTLAQEIYQEAKKVGAFALDAPVSGGDLGAKNATLTIMVGGDSETYEKALPLFEKMGKTITHQGAVGSGQHTKMANQICIAGTMTGMTELLAYAQKAGLDLDKVLNTVGGGSGATWSLANYGPRILREDYSAGFFVKHFIKDLGIALSEAEKMNLKLPATKGAKELYEQLADKGFENDGTQALIKLWWPNGHRPE

SEQ ID NO: 12420 - protein, 379 aa, Lactococcus lactis subsp. lactis Il1403
MNNTEYYERLGVDKNASQDEIKKAYRKMSKKYHPDLNKEEGAEEKYKEVQEAYETLSDEQKRAAYDQYGEAGANGGFGGGGFGGASGFSGFGGGSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQVTCDVCNGTGKEIKEKCETCHGSGHEKVAHTVKVTVPAGVETGQKMRLQGQGDAGVNGGPYGDLYVVFQVEASDKFERDGAEIYYKMPMDFVQAALGDEIEVPTVHGNVKLKIPAGTQTGANFRLKGKGAPKLRGSGNGDQYVIINIVTPKNLNQAQKEALQAFAKASGVEVSGSGKKGFFDKFK

SEQ ID NO: 12421 - protein, 339 aa, Lactococcus lactis subsp. lactis Il1403
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTLELLPALKNAKISRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLEGKGGLYCEDLNIARLMTSEEANNFSGGLRPHAIDHNDADRLWQISKNITGLDFE

SEQ ID NO: 12422 - protein, 380 aa, Geobacillus stearothermophilus
MAKRDYYEILGVSKNATKEEIKKAYRKLSKKYHPDVNKEPDAAEKFKEIKEAYEVLSDDQKRAHYDQFGQADPNQGFGGFRSDDFDLGGFSGFGGFEDIFNTFFGGGRRRNPNAPRAGADLQYTMTLTFEEAAFGKETDIEIPSEETCNTCHGTGAKPGTKPETCPHCHGAGQISTEQSTPFGRIVNRRTCPYCGGTGQYIKEKCTTCGGTGRVKRRKKIHVKIPAGIDDGQQLRVAGQGERGLTVGRREIYILSFMWSRMSFLNVTAMIFIAKCRLRLRKLRLGMKSKSRPFTGKLKLKIPAGTQTGTRLRLKGKGVPNVRGYGYGDQHVIVRVVTPTKLTEKQKQLLREFDQLGGSSMHHEPHDRFFDKVKKAFKPES

SEQ ID NO: 12423 - protein, 166 aa, Beta vulgaris subsp. vulgaris
GEGTYGVVYKARDSLTGKIVALKKVRFDNLEPESVKFMAREILILRRLDHPNVVKLEGLVTSRMSCSLYLVFEYMEHDLAGLAASPDIKFTEPQVKCYMHQLISGLEHCHNRGVLHRDIKGSNLLLDNGGILKIADFGLATFFDPNKKHPMTSRVVTLWYRTPEEF

SEQ ID NO: 12424 - protein, 497 aa, Oryza sativa
MATCLDSLGPLLGGAANSTDAANYICNRFTDTSSAVDATYLLFSAYLVFAMQLGFAMLCAGSVRAKNSMNIMLTNVFDAAAGALFYYLFGFASRRTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALNHAVRQEMADGALERDRRLQRSPRRVRAITAGCSVVDPWASVICGFVSAWVLIGCNKLALMLKFDDPLEATQLHGGCGAWGIIFTALFARKEYVELIYGVPGRPYGLFMGGGGRLLAAHIVQILVIVGWVSATMGTLFYVLHRFGLLRVSTSTEMEGMDPSCHGGFGYVDEDEGQRRVRAKSAAETARVEPRKSPEQAAAGQLV

SEQ ID NO: 12425 - protein, 495 aa, Oryza sativa
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVAACRTLGRPHRGPPHWRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSFGGFMLKSAHGTQVAAEMGGHV

SEQ ID NO: 12426 - protein, 209 aa, Nicotiana tabacum
MGSSSGSDVEAGFAKLQGEDFEYYMQTYSIILGRNSKKSTVDVDLSSLGGGMNISRHHARIFYDFQRRRFNLEVLGKNGCFVEGVLHLPGNPPIKLDSQDLLQIGDKEFYFLLPVRSILGGGPPIGPKQNVNYPVAAHYGGIGKKGGLFRGREREYYDEEEYDDDDDDDDGTGGKKMRRCDGAEGGGGYGGYGSCGSSGKASISGQLGQ

SEQ ID NO: 12427 - protein, 306 aa, Lactococcus lactis subsp. cremoris
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQLIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTEAYDRVINVTSDEALETARKIGKNEGFLVGISSGAAIWAAYELAKKLGKDQKVLALCADNGERYLSTELYDY

SEQ ID NO: 12428 - protein, 493 aa, Mentha x piperita
MAALLVFFSVSLILLAVLFHKRKSSLSSRKRPPPSPLRLPVIGHFHLIGALSHRSFTSLSKRYGEVMLLHFGSAPVLVASSAAAAREIMKNQDVIFASRPRLSIFDRLMYSGKGVAFAPYGEHWRNARSMCMLQLLSAKRVQSFGGIREEETSAMIEKIRRSKPTTVVNLSEMFMALTNGVIHRAVLGRKGDGGDDFNRILIKVIKLLGSFNVGDYVPWLSWINRINGVDAEVEKVGTKLDGSMEGILRKYRRKKVGDDETNFVDTLLQFQRESKDTDPVEDDVIKALIFDMVSAGTDTTFAALEWTMAELIKNPRTLKTLQNEVREVSRNKGGITEDDVDKMPYLKAVSKEILRLHPPFAILLPRELTQDANMLGYDIPRGTVVLVNNWAISRDPSLWENPEEFRPERFLETSIDYKGLHFEMLPFGSGRRGCPGSTFAMALYELALSKLVNEFDFRLGNGDRAEDLDMTEAPGFVVHKKSPLLVLATPRQS

SEQ ID NO: 12429 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFVAVMPESMSLERKKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDQVITVSNEDAINTAKELAKIGLMVGISSGANVFAASMLAKKFPDKRILTMLNDTAERYLSTDLFA

SEQ ID NO: 12430 - protein, 435 aa, Dendrobium crumenatum
MSKEFGIEAPLSKIAVSKAHGEDSPYFAGWKAYEENPYDAVDNPNGVIQMGLAENQLSFDLLEEYLEQHPEASSWGSGMSSFRENALFQDYHGLQTFRKAMASFMEKIRGGRSKFDPDRIVLTAGATAANELLTFILADPGDALLVPTPYYPGFLRDLQWRTGVTIFPVHCHSSNGFQLTLASLESAYADAKASNFNVKGLLITNPCNPLGTVASLSLLQDIILFISDKNIHLISDEIYFGCVFSSTNLFSISDLITNAVSYQIHIVYSLSKDLGLPGFRVGALFSYNDRVVKTARRMSSFSLVSSQTQKLLAFMLSDEEFTVNYIKKNRERLRERYELVVGGLKEAGIECLKGEAGLFCWVNMEELMEDKTEEGELRLWKVMVDELKLNISPGSSCCCSEPGWFRVCFANTSRETLEVALRRLKDFARKKTKNI

SEQ ID NO: 12431 - protein, 510 aa, Paenibacillus sp. KCTC8848P
MLTMFASGAMAEQEMNGHKPPNSVGSGVFYEIYINSFYDSNGDGHGDLKGITQKLDYLNDGNPRSGKDLQVSGLWLMPMNPSPSYHKYDVTDYYQVDPQYGNLNDFRTLTKEAKRKGVKVIIDLVINHSSSEHPWFKEASTNPQSKYHDYYVWANEKTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGKILNSVKNGRDQGIATFAEKTLKLYKSHNKAALDAPFLSNHDQTRVMSELGGDVRKAKLPASILLTLPGQPFLYYGEEIGMKGEKPDEYLREPMRWYKGEGRGQTTWEVPKYNRGEVSVEAQMRDNDSLLQSYRTLIRLREEHEALRSHNLEPIQAGSANVAAYQRSSGKETLYVYHNLSGKPVTLQMKDADKQKRKVVFSSSKGVKIKKNAVTIPAYSSLITK

SEQ ID NO: 12432 - protein, 323 aa, Halobacterium sp. NRC-1
MFTVLVSDGMGMLGALPDAVADRATRDVAFEHRRVETGEGLVAAVDDTGADAVVGGPETPVPAETIAEIDGDVAAIVRAGVGVDAIDCAAAADHGVAVANAPSYCTREVGEHALSLVFGAARRLHEYDRQTRRGGWAWNDAPAPLRLADATVGFVGFGEIARGVADTATTVAESVIAYDPYVDAATAERHGVAMAEFEAVCAQSDVLVVFAPLTEETRGLVDEAACNRLPEGAVVVNVGRGAVVDDAALAGALEDGPVSAAALDVLPTEPPVESPLVGRSDVLVTPHCGWYSEAAAESLVASLAGTVAAVADGDGVPERTRVA

SEQ ID NO: 12433 - protein, 338 aa, Halobacterium sp. NRC-1
MRFGFSEACLEHDPGVRHPESPDRLRAIKRGLQKRHGVTYEDAPDADLSDITAVHDPDYATEVRSFCERGGGSWDPDTAATESTWPAIRASAGLAMDAIDAALDGADGRDTPFSLGRPPGHHAITDDAMGFCFVNNAAVAAQHALDAHGLDRVAIFDWDVHHGNGTQDIFYDRGDVFYTSIHEDGLYPGTGSVAQTGDCDGAGTTLNLPFPTGAGDADYAAAVDDFIAPAIRAFDPDLFVVSAGFDAHHHDPISRLHLSTEGYAMLTDRVRRISARTDAPLAFVLEGGYSLDTLADGVSTVHETFDGRDPTEPEDDVSDSVRDLFERVRDTHQAFGST

SEQ ID NO: 12434 - protein, 316 aa, Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 12435 - protein, 391 aa, Halobacterium sp. NRC-1
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCDGQGVVTQVRQTPLGRVQQRQECSRCGGEGELHSETCSTCGGQGQTRERATLTVDIPEGIRTGQTLRMDGEGAPGEPGAPNGDLLVDVTVEEHPDFERDGDDLHHRHAVSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 12436 - protein, 274 aa, Halobacterium sp. NRC-1
MIEQMLASGELPEGGTIIEPTAGNTGVGFAVAASQLGIDAVFVVPERFSLEKQQLMRALGADVVNTPTDDGMGGAIQRAHDLAAEREDAIVPQQFSNPLNAEAHYETTGPEIYHALDGAVGAFVAGCGTAGTLMGTSRFLRDQISALHVTAVEPEGSMYASAAGADVSEGEYKTEGIGTHDPSTSELFDPEFVDDVTQIPDEDTHAEMQRLAAEEAQLVASSAAANSLAAIDVAERAAAGHIDLPHDCVVTVFPDSSERYLSKGLYGDYEEWEG

SEQ ID NO: 12437 - protein, 503 aa, Halobacterium sp. NRC-1
MTYQHYINGEWVDGDGTETFDSRNPANGETLGTFQRGTTTDVEAAIAAADDAEDEWQSLSRIDRAEYLWDIYHELKDRHQELGEVVTKECGKEISEGKADVTEAWQMVEWAAGDARHPKGDVVPSEIPEKDAYMRRQPRGVVGCITPWNFPVAIPFWHMAVALVEGNTVVWKPAEQTPWCGQIIAEMFADAGIPDGVFNMVQGFGDAGARIVDHDDIDTVLFTGSAEVGEEVARTVADDPGKLAACEMGGKNGIVVTEKADLDIAVHAAVMSSFKTTGQRCVSSERLIVHEDLYDEFKQRFVEIAESVAVDDPLDEETFMGPAIEPAHVEKIQTYNDIAREEAENVLVDRTELGDDEIPDGHEDGNWVGPFVYEVDYDPDLRSITEEVFGPHVALIEYSGDIERAVEIHNDTPYGLAGAVISEDYRQINYYRDNAEVGLAYGNLPCIGAEVQLPFGGMKKSGNGYPSAREVIEAVTERTAWTLNNSKDIEMAQGLSADINTDE

SEQ ID NO: 12438 - protein, 453 aa, Halobacterium sp. NRC-1
MDDINPATGARIDTYETDTAADIEAALARAADAANDWRDRPIRERERHVAAAGDVLRENTQTYAELITAEMGKPITQARAEIEKCAAVCDHYATHASAYLQPDGHPSPAGADVQTVYEPLGPVLAVMPWNFPFWQVFRFAAPALAAGNVALLKHASNVPGCAEAIADVFEAAGLPAGVFQTLLVGADAVEDVIRDDRVRAATLTGSEPAGSAVAATAGETLKKTVLELGGSDPFVVLDDADVAAAAASGAWARTLNSGQSCIAAKRFIVHTDVYEAFRDAFVSEIDSLTVGDPTREETDVGPQASAAGLDTTHEQVRASVDAGATVVTGGQPSDREGAFYEPTVLTDVPAGCPADTEELFGPVAAVFEVPDEAAAIAKANATAFGLGASVWTADRDRGRRVARAMDAGCAYVNQPVTSDPRVPFGGIGRSGYGRELAGAGIRAFVNRKTLWVE

SEQ ID NO: 12439 - protein, 377 aa, Halobacterium sp. NRC-1
MAESASRRHADDTSRSTAEFSGSDTVLELDGVTKEYGAETAVRDLSLSVREGELLTLLGPSGCGKTTTLRMLAGLERPTGGTIELDAQRVAGPDTFVAAEDREIGIVFQDFALFPHLSVAENVAFGLTDRDEDATAARVDEMLALVDMPEMGDRSVDQLSGGQQQRVAVARSLAPEPDILLLDEPFSNLDVRLRVEMREEVRRILKEAGVTAVSVTHDQEEALSISDRVAVLNDGCIEQVGDPEGVFEHPESRFVASFLGQAAFLSARVGSDTVDTAVGSYDRALLAGLTDGYQGAMVDVLVRPDDLRAAPVADATGAGNGTIVKRQYTGPSFIYHVELDNGDVVRCLHNHADNMAIGEPVAVSLVSDHALAWYPTE

SEQ ID NO: 12440 - protein, 366 aa, Halobacterium sp. NRC-1
MADSFSPLELRDTTIRNRFAMSPMCQYSCEDRDGLATDWHRVHLGSRAVGGAGVVMTEATAVEERGRISPEDLGIWSDEHGEALAPVAEFISDQGATPAIQLAHAGRKAGTARIWGDDSGPVPLDEGGWDPVAPSADPYPYEDDERDTRKLSTADIEDVVEAFRDAARRANEAGFEVAEIHAAHGYLIHQFLSPVSNHRDDEYGGSFENRTRLAREVTSAVREEWPDDKPVFVRISATDWIDDRDSWTVEESVQLADDLHALGADLIDVSTAGIHPDQDIQSGGPNYQLQFAERINADTERDVAVGTVGGIQSAEQADAIVRNDRADLAIVGREFLRDPYFPLHAARELGREDAADVPPQYRRGFQ

SEQ ID NO: 12441 - protein, 480 aa, Halobacterium sp. NRC-1
MEQNAIQRRERPFVAGEWVSDGEPLPVSDLADGGTFASVAAADTSDAERALSAATGVHADLRETTVPERVEWLESIADGIRRREDELAEVIVREAGKPISSARGEVQSAAERFDRAVGELRHLTGEYRTGTTAGHEDWQAIVKHEPMGTVLCITPYNYPLSTMALQVAPAIAAGNAVIVKPASKTPISGAILADIAADAGLPDGAYNFVPGESSVIGDPLASDARVDAIAMTGSSGAGEHVARQSGITRLHMELGGNAPAIVFEDADLDAAADAATAGSLKYAGQRCSAVSRVLAHESVHDELVSRIDDAMAEWSIGDLFDTDTTLGPLVSADQADWVAELVDDAVDRGATVVRGGERHVEDGVHYYEPTLLADVPRDARIVDEEQFGPVCAVTTVTDEDDAVRTANGSELALDAAVFTADHDRAMRVAERVNAGAVRINGAPSHGLGDVPFGGNDASGIGREGLDSTIHEFVREKSIIL

SEQ ID NO: 12442 - protein, 493 aa, Halobacterium sp. NRC-1
MRDEVTLQATTNPDRPALVDAATDRTWTYDALDSAVDATAGSLAALGVTPGDRVAVLLETRPAFATLVFAAARLGAVLVPLNARLSQPELATQADAVAPVAVICGRDTATAADRLDAPAVRVADDATVRPLSGTDPDAVTPVDSAWDDTRLLLFTSGTTGDPTAVRLTYRNLAASAAASAARLGVLPDDRWLCPLSMYHTGGVSVVLRTALYGTTAVLTRTPGFDAAAVGDALETHDCTGVSLVPPMLDRLVEADAVPDSLRFALVGGAPTPPELVERACAAGVPVCPTYGATETASQAATLHASDAPAHPESVGRPLLGTTVTVVEPDTHTPVPDGQAGLLAVSGPTVTPGYAGEGTAPRCEHGLLTGDRGWIDADGFLHVGGRASDEIITGGENVRPEAVAAVLREHPAIEAVAVVGVPDDAWGDRVGALVVPADDTADVSVASLRAFCDGRLAGYKHPRVVAAVDALPRTASGTVDRQAAVAELRDDAAP

SEQ ID NO: 12443 - protein, 398 aa, Halobacterium sp. NRC-1 [sequence omitted]

SEQ ID NO: 12444 - protein, 277 aa, Halobacterium sp. NRC-1
MTTHGWFADTAVRDADAAADAVRNGHADAPENWPAAAVEDGVVDDADEYYDRLRDATRAATRAAVRERERADDQQLVHAVRTIGDLSDAANEVAERAVEWARTLFDGVDDGIAGARDVAGRSANSPTEERAIALCERATDLADERDRAQGFVETHAPTVAPNLSMLAGPVLAARLIALAGGLDDLAKLPSGTVQVLGAEDALFAHLRGHAPSPKHGVIYTHEYVRGTHPDQRGSAARALAGKLTIAARVDHYSGDRRPDLEAELDARMERIRARETE

SEQ ID NO: 12445 - protein, 210 aa, Halobacterium sp. NRC-1
MSLPAGVQRRSFGDEDGVLATRGEPAYGEPVVDGWRRWDAHRSKLGATFELGLDTGLSGGDAVLYLGAANGTTVSHVADFAGPTYAVEFAPRPVTDLLAVADSRERLFPLLKDARAPETYAHVVESGVDAIVQDVATRGQADVALSNRQFLADDGRLVAALKARSEDVTADPAAVFEDLLGRLRDGYEVRATARMEPFHEDHLAVVATPR

SEQ ID NO: 12446 - protein, 398 aa, Halobacterium sp. NRC-1
MAIRTLDDLAAANRAIGVRVDINSPLTAAGGLADDARLRAHVDTLAELLAADARVAVLAHQGRPGGDEFARLERHADRLDALLDAPVSYCDATFSTGARDAVADLAPGEAVVLENTRFYSEEYMAFAPERAADTALVDGLAPALDAYVNDAFAAAHRSQPSLVGFPEVLPSYAGRVMEAELDALSGVADTPTPRTYVVGGAKVPDSVEVAAHALSHGLADNVLVTGVVANVFLAATGVDLGRASTDFIHERDYGTEIARAADLLAAHNDALHLPVDVAVERDGARCELSTDALPPAGDEAVCDIGSDTVDAYADVLADSETVVVNGPAGVFEDDLFADGTRGVFDAASEVEHSIVGGGDTAAAIRRFDITGFDHVSTGGGAAINLLTDADLPAVAALR

SEQ ID NO: 12447 - protein, 472 aa, Halobacterium sp. NRC-1
MAAVDRNAAALGVPRAQLMESSGHAVGRAVKRVADPGASVAIVAGRGNNGGDAFAAARFLDDYAVSVSLLGRPESINDRISRANWDALQAGGYDTTTVRDAHALALDDPDVVVDALLGTGISGPPREPEATAIERINATDAPTVAVDVPSGLDADTGATPGSAVDADRVVTFHDTTPGLADHDHVTVADIGIPEAAETVVGPGDLLGVDRDPHGHKGDAGSVLVIGGGPYTGAPALCAQAALRAGADLVRLAVPDAVAAEVQGFDETFIVDSVVGTRLVEEHVPDLLARAEDADAVVIGPGLGDADTTQAAVAAFLAAFEGRAVVDADALTAVPDVETDATLVCTPHRGELQAMGGPTVDGSQPSRDAVEGFAAELGQTLLVTGARDVLSDGDTTRVNRSGTPGMTVGGTGDVLAGTAAAMLATQPPIQAASAAAYATGGAGERAAEARGHGLLATDICDALPAAIWGGQDA

SEQ ID NO: 12448 - protein, 327 aa, Halobacterium sp. NRC-1
MKDSILDAIGTPLVRLTAPEGATIAAKLEGFNPAGSAKDRPAREMVLAAERAGEIQPGDQLVEATSGNTGIGLALTAAARGYDLTIVMPASMSTERKQLLRAYGADLELVDAGMETANQVADRVAADTGAFRVGQFENPANPRAHYRTTAEEILDQVEGREIDALVAGVGTGGTITGTATRLREAHPEMSVVAVEPEANAVLSTGESGDDDFQGMGPGFVSDNLDRELIDTVETVAVDAAEAETRRLAREEGVLVGQSSGAAALAATRTAERIADPSLDCPDVSFDADAVGDPDAIADGGDGPDDCPLVVTILPDTGERYLSAGVFD

SEQ ID NO: 12449 - protein, 458 aa, Halobacterium sp. NRC-1
MDRETAEPDVRSMPGEKAAEWVNFHHNHAAPSTYVYDFVWDITEDAIGPFCTDVDGNVLMDFTSHVAAAPFGYNNPKIMDRLESFDLVDPLKMAGQDFYAGGGTDPESPEIPTATQLLDRLTDITAHYDLDTVFLSNTGAEAVENAIKICYNNGGHRALTFDGAFHGRTLGALSLNRSKAIHRKGFPEIGGVVSVPYCTCEGECSCGWKTNGPGGNVAADKLHHDRGVIDPEEVAYLIMEPQQGEGGYRVPNDDFIADIADIQRTHDIPVISDEIQAGLGRTGELWGIDHTEIEPDVITSAKGLRVGATVANEDLFPSETGRLSSTWGAGDIVAAAQGVATIDAITSDGLLDHVVARGEQTTDRLHDADPDFVTDVRGRGLMLAVEFDTKKRREAVVNACVKRGLLVLGCGHKTVRLLPPLDVTEREIDIAVDILLEALDDPDVRHAGTSKVEGEPTA

SEQ ID NO: 12450 - protein, 216 aa, Halobacterium sp. NRC-1
MSHPNVLLLGAPGAGKGTQSRRLVDEFGVEHVTTGDALRANKTKDITHLDVEYDTPGAYMDAGELVPDAVVNEIVKTALDDADGYVLDGYPRNESQTEYLDSITDLDVVLYLDVDEDELVGRLTGRRVCEDCGATFHVSFNQPETEGVCDACGGSLYQREDDTEETARERITVYEENTAPVVEYFREQGVLAEVDGERTPDEVWTDVAAAVDERTA

SEQ ID NO: 12451 - protein, 272 aa, Halobacterium sp. NRC-1
MFPGASTADESNPGADADYVVVGAPLDVSTSFQPGTRFGPGELRTYAATFEDYHHRTGTHFSALSVTDYGDVRAWNDVPAYLEYLNGVVTDISWNDATPLLVGGEHTVTVAAVRALNPDVFVALDAHLDLRAALDGDPLSHSTVTRHALDVADEAIVVGARAGSEEEWERAADSDVTVIEPSAVADWTPAFGDADVYLSVDIDAADPGYAPGTGTPEPFGMSPRELRAAVRAVAPHAVGFDVVEVNDRDDGQAPTLGAKLLREFVHTHHADG

SEQ ID NO: 12452 - protein, 417 aa, Halobacterium sp. NRC-1
MSASYVIIGDGIAGSSAAEAIHEEAPDADITVLTDEGETLYNRILIKEYAKGKLPEAPISIHDPEWYDERDIDIQLNTLVTRINPDAHTVETHEGTEIEYDKLLVAAGGTPNDLPVENADADGVHHFWTFEDARRIREHAEAADTGVVVGAGLLGIDLAAICGGQDVDAKYLMRGNRWWRYALSEAGAEIIHEGLREKGVEPVFESGVDHFEVDDDGALAAAVDGNGVRHDADFAGVAIGLDFNVEILQDTDATIENGVHVDEYMRTEVDDIYAAGDITQYWDTILDERAQNGSWGSAKQQGALAGRTMLADSGHDVEIEPFRWVSSYSITHFDFPFLSFGFPTIGDETCERSYGDNEWRRLAFKDGQLVGGVLIGNLAPQSKYKQLIKEEAVVADQQDVLLQDNFEMDELGAATQQ

SEQ ID NO: 12453 - protein, 508 aa, Halobacterium sp. NRC-1
MQAALVILDGWGLGDHDRRDAVRAADTPTFDEYAERGAFGTLTTSGRDVGLPDGQMGNSEVGHLTIGAGRVVKQAYTRIEDAIAAGDLCGNDAISGALDHVADTGGTLHVMGLVSDGGVHADQQHIHALVECAAGRGVEAAVHAFTDGRDTSPTGGEDYLADLEAVADEHGTGDVASVSGRYYAMDRDQNWARTKRAYDAITRSDGVAHHAAAAVDAVTDSYERGDTDEFVEPTTIEGGAALSDGDAVVFANFRADRARQLTRLLADIHPADWDADGIETNPPAVPVVTMTEYDETFDCPVAFPAAEPTDTLGAVLAAHDHTQLRVAESEKYAHVTYFLNGGREVAFDGETRTIVDSPDVPTYDEQPAMSAPAVTDTVLDALAGDDPDVLVLNYANPDMVGHTGDFDAAIEAVEAVDRELGRLVPALNDAGAHAFLTADHGNADDLGTPADPHTAHTFNPVPFVSLPPASGDTAAVRDGGALRDIAPTLLDVLGIDRPTVMTGASLLE

SEQ ID NO: 12454 - protein, 426 aa, Halobacterium sp. NRC-1
MRIDIGAALDATATPGVPPDALDRLDDRVAHAHDRITAGMDGDEFGYAALNLPRTVDVDAITAAADAVADADTLVTVGIGGSALGAATLVDALGDDDLDYHALDNVDPAHVTRLLDRIDLSTSAVHVVSRSGTTAETLANFLVVRDAMDDAGVDWTARTLVTTGDDGPLRALADTHDLPVLDAPRGVPGRFAALSTVALPAAAIAGVDVGELVAGAADGRAALAGSLEDCSAYAYGATAYALDQRGAGVNAMLPYAERLETFAEWFAQLWAESLGKDGVGQTPARALGATDQHSQLQLYRAGPRDKLVTMLRPASRPDCAIPEAELADIDYLTGGDLGALLDAEFEATAASLAASGVPTVRVEVPAVDARSVGRLLFDFEAACVLAGELYGVETFTQPAVEWGKNAARELLRGEDPLPETETHIVE

SEQ ID NO: 12455 - protein, 454 aa, Halobacterium sp. NRC-1
MTNGDSSSSALTDNERAVLDDIEAQGIDFLRLQFTDILGTVKNVSIPAHQAEKAFTEGIYFDGSSIEGFVRIQESDMRLDPDPETFAVLPWRSNGDGGSARLICDVVDREGNAFAGGPRQVLKNVLARADDMGYSVSIGPEPEFFLFEKDDDGNATTTAHDQGGYFDLAPKDLASDIRREIIFTLEAMGFEIEASHHEVARGQHEINFKYDDALTTADNIATFRAVVRAVAEQHDVHATFMPKPIGEINGSGMHSHISLFDEDGENVFADNDDEFNLSETAYQFMGGVLEHAPAFTAVTNPTVNSYKRLVPGYEAPVYIAWSGVNRSALIRVPDAAGVSARFEIRSPDPSCNPYLALAAVIAAGLDGIDTDADPGDAVREDIYEFDEDKRDAYGIDTLPGHLGDAVTALESDPVMQDALGEHVCEKFAEAKRHEYAEYKASVSEWETDRYLEKF

SEQ ID NO: 12456 - protein, 478 aa, Halobacterium sp. NRC-1
MGLAEYFGFDDHDTDLRTELVAGLTTFLAMSYIVLVNPVVMTQRTTAGEVVKPGIALANYSHDQTVQMLAVVTLLASGVAMLVMAFYANRPFALAPGLGLNAFFAFTVVGTLGVPWQTALAAVFTEGLLFIVLTAVGAREYVITLFPEPVKLAVGTGIGLYLAIIGLEAMGIVVGDAGTILALGNLAQNPVAVVSILGLFFTIALHARGVTGSIVLGIIATAATGGVLTFAGVVDPGVLIGDFVRTGGIATQRLPHAQYDITPLVGAFLAGFQDIDAFSFALIVFTFFFVDFFDTAGTLVGVGQAGGFLNTDGNLPDADEPLMADAIGTTFGAIIGTSTVTTYIESATGVEEGGRTGMVALVVAVLFFLSLLVVPLAAAIPQYASHIALVVVALLMLANVTAIDWDDITHSIPAGLTIIVMPFTYSIAYGIAAGIVSYPVVKVATGDADEVAIGQWLLAAAFIVYFYVRTSGVLAAAV

SEQ ID NO: 12457 - protein, 474 aa, Halobacterium sp. NRC-1
MVVGDISTGTDVAVVGAGPGGYVAAIRAGQLGLDVTLVEKDAYGGTCLNYGCIPSKAMITASGVAHEAGHAEEMGVYADPDVDVAEMVDWKDGVVDQLTGGVEKLCKANGVNLIEGRAEFAGSDKLRVVHGGDGQGSETIEYEHAIVSTGSRPIEVPGFDFGDDPVLDSRQALAMAELPSSMVIVGGGYIGMELSTVFAKLGVDVTVVEMLDGILPQYGDDIARPVRQRAEELGIDFHFGLAADSWTDTDDGIVVTAADEDGEETEFETEKVLVAVGRQPVTDTLNLDAVGLEPNDDGRLETDHEARTDVENVFAIGDVAPGPMLAHKASKEGEVAAEVIAGEPAALDYQAVPAAVFTDPEIGTVGLTEDDAAAQGFDPVVGTFPFNASGRALTTGHDDGFVEVVADEESGFLLGAQIVGPEASELVAELGLAIEMGATLEDVASTIHTHPTLSEATMEAAEHALGHAVHTLNR

SEQ ID NO: 12458 - protein, 270 aa, Halobacterium sp. NRC-1
MDTVTLGPAGTYSHRAASAVSAGDVSFMESVRDIVDAVAVGDADRGVVPIENSIQGSVTETLDALADTDGLAVVREVVTPIRHALLAQDDGFDAVASHAQALAQCREYLDATHPAVDRRAVASTARGVEVARNDETTAAIAHPDSADGTELDVHGSGIQDRASNETRFFVVGPASERTPAGGKSSIIVYPNANHPGLLLELLEPFADRNINLSRVESRPSGERLGDYVFHVDIASGCYEERTRNAVADVAEIAAAGWVRRLGSYDTEHVA

SEQ ID NO: 12459 - protein, 129 aa, Halobacterium sp. NRC-1
MEEFDVDLDFGGAGHTDDGDGLVAVIAQDADSRDVLMLAYATREAVARTATTGRAHYYSRSRDELWEKGATSGNTQSVDEIRVDCDGDALLYLVAQTGGACHTGHESCFHRTLDGDTVGDQVFDPDDAY

SEQ ID NO: 12460 - protein, 445 aa, Halobacterium sp. NRC-1
MNRETSRELYDRSLDVLVGGVNSTVRAAPQPYPTFVQSGDGGHVIDADGNRYIDWVMGLGPLLLGHDLPQPVTAAIQRRASDGPLFGTPTEIEVEHAEFVARHVPSVELLRFVNSGTEATVSAVRLARGYTGRNKIVVMQGGYHGAQESTLVEGDADHRGPSSAGIPPAFAQHTIPVPFNDADAVTEVFETHGDDIAAVLVEPILANKGIVEPVAGYHETLRDLTHDHGALLIWDEVITGFRVGGLGCAQSEFDITPDVTTFGKIIGGGFPVGAIGGRTDVMEEFTPTGDVFQAGTFSGHPVTMAAGLETLQYAAENDVYEHVNRLGGRLREGLAAVVAEHAPAYTVVGRDSMFKVVFTRDGDAQSGACTDGCRQDPDCERHAACPKTGADVGDAAVQRWNRVFRPQLLDAGVLLSQNQFESQFVSYGHTEADVDETIEAYRSAL

SEQ ID NO: 12461 - protein, 337 aa, Halobacterium sp. NRC-1
MGEMGFYAPNLDGYGLPNVSETAYGLLMQELEACDSGLRSMASVQGALVMYPIHAFGSEAQKERWLPALGAGEAVGCFGLTEPEHGSNPSAMETTAEPDGDEYVLNGSKTWITNSPIADVAVVWARDHGEDGTPVRGFLVETDRDGVTTNEIDEKLSLRASITGEISLRNVRVPAESRLPGVEGMKGPLSCLTQARYGIAWGAVGAARNCFETAREYATDREQFDQPIGGFQMQQDKLAEMATQITTSQLLAHRLAGLKERGDLRPQHVSMAKRNNVRMARDQARVAREMLGGNGITTDYPPMRHMANMETVYTYEGTHDIHTLILGEDLTGMQAYQ

SEQ ID NO: 12462 - protein, 489 aa, Halobacterium sp. NRC-1
MSDLDFGDVDWNVQYIDGEYVPPGDRGTLEVDDPSTRELFTEIPAGTTDDVDAAYEAAADAQTEWADTPPQERARIVAAASEILASHRDEVVDLLATESGTTYTKGAAEFEASVGITDEAASFPTRMNGDHKQSVVEGKENIVVREPQGVVGIISPWNFPLNLSIRAVAPAVAAGNSVVLKPASNTPVTGGLLIAKVFEAAGLPEGVFNVVTGKGSEIGDRIAGHPHADVISFTGSTAIGRQVAATAGENLALPAMELGGNNVHIVTEDADLDDAVDSGVFGSFLHSGQICISINRHVVHEDVYDEYVERLTERAAALPTGTAHDADTVVGPIIDESQRDQILDYIERTVDAGATLETGGDHDGLVVEPTVLSDATNDMAAACNEHFGPVAPVIPFSDDDEAVEIANSTEYGLSGSVHAGDTGRARDIADRIDTGMIHINDQPVNQEPHLPFGGYKNSGLGRYNGEYVLNEFTQEKWVSIQRETRDYPF

SEQ ID NO: 12463 - protein, 305 aa, Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 12464 - protein, 470 aa, Arabidopsis thaliana
MADGNTRFTVDEALVAMGFGKFQIYVLAYAGMGWVAEAMEMMLLSFVGPAVQSLWNLSARQESLITSVVFAGMLIGAYSWGIVSDKHGRRKGFIITAVVTFVAGFLSAFSPNYMWLIILRCLVGLGLGGGPVLASWYLEFIPAPSRGTWMVVFSAFWTVGTIFEASLAWLVMPRLGWRWLLAFSSVPSSLLLLFYRWTSESPRYLILQGRKAEALAILEKIARMNKTQLPPGVLSSELETELEENKEPGFSLLALLSPTLMKRTLLLWVVFFGNAFAYYGVVLLTTELNNSHNRCYPTEKQLRNSNDVNYRDVFIASFAEFPGLLISAAMVDRLGRKASMASMLFTCCIFLLPLLSHQSPFITTVLLFGGRICISAAFTVVYIYAPEIYPTAVRTTGVGVGSSVGRIGGILCPLVAVGLVHGCHQTIAVLLFEVVILVSGICVCLFPFETSGRDLTDSISASKEPPSASV

SEQ ID NO: 12465 - protein, 469 aa, Escherichia coli O157:H7 EDL933
MMGRCLFGFSGEKPFLLPDNEGVKMNTSPVRMDDLPLNRFHCRIAALTFGAHLTDGYVLGVIGYAIIQLTPAMQLTPFMAGMIGGSAHLGLFLGSLVLGWISDHIGRQKIFTFSFLLITLASFLQFFATTPEHLIGLRILIGIGLGGDYSVGHTLLAEFSPRRHRGVLLGAFSVVWTVGYVLASIAGHHFISENPEAWRWLLASAALPALLITLLRWGTPESPRWLLRQGRFAEAHAIVHRYFGPHVLLGDEVATATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLAAVLLAGFVVTWLWAPETKALPLVAAGNVGGANEHSVSV

SEQ ID NO: 12466 - protein, 244 aa, Deinococcus radiodurans R1
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDABVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 12467 - protein, 487 aa, Deinococcus radiodurans R1
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 12468 - protein, 454 aa, Deinococcus radiodurans R1
MTATQAKPRQPDLKTSLPGPKTAEIMARDQATLSTSYMRPYPFVPDFGKGVWLTDVDGNTMLDFFAGIAVSTTGHAHPHVVQAVQRQIEKFTHVCLTDYPQEITTSLAERLVKHVERPGEKWRVFFSNSGAEAVEAAVKLARNHTGRQHIISTMGSFHGRTYGAITLTGSKTKYKRGFGPLLPAVSHVPYPNPFRPPLGSTPENCGQAVIDHIESLFVGILPADEVAAIIVEPMQGEGGYIVPPADFLPGLRALCDKHGIMLIFDEVQAGMGRTGKMFSFQHFDVQPDIITSAKGIASGMPLGALLAKESVMTWPVGSHGSTYGGNPVAAAASHATLDLLEGQVKHEGCGDSLMDNAAQVGDFILGELKGMQDEFPFIGDVRGRGLFIGIEFVKPDGSPDGALRDQASMMMFEKGLLNLDCGEAVIRISPPLILTREEAATGLDIMRGVFQELK

SEQ ID NO: 12469 - protein, 372 aa, Deinococcus radiodurans R1
MPTACRGAVQMSSFVPVILAGGSGERFWPLSRRHRPKQFLTLDESGRSLLQATSDRLARLGGGQDRVVVVTGNDYRSQVLEQLPEMPIENLLVEPAARDTAAAILYAALWIAQDDPQAVMGVFPADHRVTDVEAFERVIQRAIEVAQESERLVTVGIAPTFPSTGYGYIQQGEVLQPGELPAFSVTRFTEKPDAVTAQAFLDTGRYTWNSGMFIWRVQSILAAFEQHQPQLYKQLHQVMSAGTASARRVQLQTTFPQLEKISIDYAILEKSDRVAVIPAEFGWDDLGDWNALERLLKGEGDNVAVGRHVGLDTGGAILYTTNGDDLIATIGLDDVVVVRAEDVTLVVRKDRTQDIKKVVQQLKAHPELERFA

SEQ ID NO: 12470 - protein, 473 aa, Deinococcus radiodurans R1
MPIKFGTDGWRDIIAEDFTFENVRTVARAHAQVLRSSGARSVAVGFDTRFQGQAFARVVAEVMAAQGLDVWLAQDYLPTPALSFAVVHHGAGGGVMITASHNPPQYSGYKIKGSYGGSATPAVVAQVEAALATAESYDGPRGEIRPLDIRQAYYEQLDRQLDLETLREYRGKVIHDPMGGAACGWLTGYAQHAGLQLELEEMHGRPDPLFYGVNPEPIPQNLGELTERLTRESAPTLGVITDGDADRVGAITAGGHFFNSHQIFAVLIKHLYGRGVRGRVVKTVSGSRVIELLAETLGLELLETPVGFKYITDAFLEGQQDESKAVLMGGEESGGLSSRGHIPERDGLLNSLLMIEAVAASGQSLDELFAEIEREVGFRHVYDRADLHLSEAFDKSALMQAAQGYREVAGQAVTGIKTTDGVKLALAGDASVMFRASGTEPVVRVYVEAQTPEMVQAVLTEAVQRVRSFDPMS

SEQ ID NO: 12471 - protein, 464 aa, Deinococcus radiodurans R1
MRGRRAGGGGPDRAGRGVKAVPVLTAQQAASRVKSGQTLLVGGFGMTGNPVHLVHALAETDVRELTYVANNVGEAGLSGGRLLRNGQLKKAVGSYFTSNREAVQAYQGGQLDVQLIPQGTLAEALRAGGAGIGGFFTPTAAGTVVAEDAETRTLNGQEMVFVPALRGDVAFVRAWRADRAGNLQYRLTEQNFNRAMATAADLVIAEVEEIVEVGEIAPEHVHTPGLFVDYLVQATLTPADLGSSADVRSGAKKVDDARLNIARRALQELRPGDVVNLGIGIPTLVADLITEDMNINLHTENGMLGVGPAPEGGGAMDYPVNAGKIPVTALPGASYFDSADSFAMIRGQHVDVAVMGGLQVDEAGNLANWAVPGKPLLGVGGAMDLASGAGRLIVTMNHTDPDGTPKLVQECTLPLTARGVVDMVITEQAVFEFVDGRLTLTELQPGATLESVQASTGADFDVRL

SEQ ID NO: 12472 - protein, 231 aa, Deinococcus radiodurans R1
MNKEYPSAAEALRDIVHDGQTVAVGGFGLCGIPEQLIVALRDSGAKDLTAVSNNAGVDGWGLGLLLQTRQIRKMISSYVGENKEFERQYLSGELELEFTPQGTLAERMRAGGAGIPGFYTKTGVGTLVAEGKEHKDFDGETYILERGIRADLALVKAWKADRAGNLVYRKTARNFNPLAATCGKVTVAEVEEIVEVGDLDPDHIDTPGIFVQRVVVNATPEKRIEQRTVRQ

SEQ ID NO: 12473 - protein, 430 aa, Deinococcus radiodurans R1
MSNVFYRSSKPYPVAVRGEGVFLYDDAGRRYLDGSSGALVANIGHGRAEVGERMAAQAARLPFVHGSQFSSDVLEEYAGRLARFVGLPTFRFWAVSGGSEATESAVKLARQYHVERGEPGRFKVITRVPSYHGASLGSLAASGMGARRELYTPLMRPEAWPKLPKPDPARNGAEDAEGLRALLEREGPETVAAFMAEPVVGASDAALAPAPGYYERVRDICDEAGIIFIADEVMSGMGRCGSPLALSRWSGVTPDIAVLGKGLAAGYAPLAGLLAAPQVYETVMGGSGAFMHGFTYAGHPVSVAAGLSVLDIVEREDLTGAAKERGAQLLAGLQALQARFPQMMQVRGTGLLLGVVLGDLATGQAFETPGIASRIGAAALKRGLITYPGSGAEPNGRGDHLLLGPPLSITAAEVDELLALLAGALEDVLG

SEQ ID NO: 12474 - protein, 495 aa, Deinococcus radiodurans R1
MTAEPQVSPAPTPPPAAPLLVRDRLFIGGEWVTPCGQGTLEVVNSATEEVMGTVPEGTPEDAERAILAARAAFDSWSQTPAEERAALLERISRGLNERQSEIAALVAQEVGMPFVLSNVIQVGLPAVTFMSMAEEIRQLPAEETLASSLLLREPVGVVAAITPWNYPLHQIAAKVAPALAAGCTVVLKPSEVAPLNAFVLAEIIEAAGAPAGVFNLVTGTGPVVGEVLAAHPEVDMVSFTGSTAAGKRVSELAARTVKRVALELGGKSPYLILDDADLSGEALVQAVMNGIQGCYLNSGQTCSALTRMLVPRSRLPEVEAVAQAVVSQVKVGSPFDAATTLGPLVSDVQRERVRGHIRQGVAEGARLIAGGAESPEGLERGYYVQPTIFSDVTPEMTIAREEIFGPVLVIQPYEDEEDAVRIANATHYGLAGGVWSSDRERAVRVARRLRTGQVSINGGAFNPVAPFGGYKQSGNGREFGRLGLEEFMEVKALQF

SEQ ID NO: 12475 - protein, 304 aa, Deinococcus radiodurans R1
MSGPAHLPYGGIPTFARAPLVQPDGDWQADVAALGVPFDIALGFRPGARFAPRALREASLRSVPPFTGLDGKTRLQGVTFADAGDVILPSLEPQLAHDRITEAARQVRGRCRVPVFLGGDHSVSYPLLRAFADVPDLHVVQLDAHLDFTDTRNDTKWSNSSPFRRACEALPNLVHITTVGLRGLRFDPEAVAAARARGHTIIPMDDVTADLAGVLAQLPRGQNVYFSVDVDGFDPAVIPGTSSPEPDGLTYAQGMKILAAAAANNTVVGLDLVELAPNLDPTGRSELLMARLVMETLCEVFDHV

SEQ ID NO: 12476 - protein, 464 aa, Deinococcus radiodurans R1
MTSSSPQGAPPSGLDRFFGLTTSGSTVPRELRAGLTTFLTMSYILFVNPQVLSAAIPVPGAFAQLLTTTAIAAAFGSLVMGLIAKYPYAQAPGMGLNAFFAFTVVLGMKVPWQTALGAVFISGVLFVLLSLLGARQAIVQAIPRGLKFAITAGIGTFLAFLGLKSAGIVVTNPATFVGLGSLTAPGAWLALLGLVVTAGLMVRRVTGAILWGILLTSAAAIVLRLPVFAGGAEGALQAFPGFQGSLLGIFGAPVWPVDLVGQLDIGGALGLGLLNVVFTFFFVDFFDATGTLTGLSQKAGFLDEHGNMPRARRLFAMDGLAAMFGAFMGTSTTTAYVESASGIGEGGRTGLTAVTVGVLFLFAMLLWPLAAAIPAAATAPALILVGALMMEGIKQIDWDDLTESLPAFLTIIMMPLTFSIANGVSLGVISYCLIKLIGGRGREVSPLLYGLGLLLLARYLWLQH

SEQ ID NO: 12477 - protein, 454 aa, Deinococcus radiodurans R1
MSIQSFEEKSVPMTVDRVLDDLGLGRFQWKLLAICGLTWAADAMEVLLMGFALPGISAAFELPKGSPAATMLLTATFAGMLFGAWFWGYLADRVGRRSVFLTTVALGVVFGLAGALAPTLTWLLVARFLTGFAIGGTLPVDYSMMAEFVPTAWRGRFLVYLESFWAVGTVVVAALAWWVSTAFAPAEGWRWLLGLAALPGLVGLIARIGIPDSPRSLLARGEEAQARAALQKVAQANGGTLPAAPLAHPEQPPRVSPAQLFRGVLARRTPLLMVTWFGLSLGYYGIFSWLPSFLRAQGLDLGAVYRSTLLLALAQVPGYLLAAYLVEKIGRRVTLVGFLTLGAVGAYLFLLAHDANTVLLTSALLSFALLGAWGSLYAYTPELFPTPLRTTGMGLVSGVARLASVVSPSIGAMLLTGNLTLALTVFAVCFALAALAAWGIGVETRGQALAETAE

SEQ ID NO: 12478 - protein, 474 aa, Deinococcus radiodurans R1
MTDLSPLLTDLYQLTMMQGYFLSDLHRQQATFDLYFRRLPFEGGYAVWAGLEPMLDWLQGLHFAEADLDYLASLGQFRPEFLAALREWRFSCEVTAFPEGSVVFPHEPLLTVRGPLWEAQLVETALLNTLNFQTLVATKAARCVLAAQAGGGTVLEFGARRAQGPNGAVSAARAAFVGGAVGTSNLEAGRQFGIPVSGTHAHAWVESFPTELDAFRAYAEFYPDSTTLLLDTVDTLGSGLPNALTVAAELRAKGHELGGVRVDSGDLAYLSRVIRERLDAAGFPDVKIVVSNDLSESVISGVIAEGGRVDVYGVGTQLATAGGPGGGALGGVYKLAELNGRPRMKLTGDPAKSSLPGTKAVWRGLDHDHFAWDVLTLGDAPHEGLRVSDPTNPLRSARLTSRLHWRPARDLVMSGGQRTRPAEALPALQARAREELARLAPETRRLLNPHVYRVSLAPEVSELRDRLAQELRGH

SEQ ID NO: 12479 - protein, 386 aa, Deinococcus radiodurans R1
MFDYFKMLDLVSPDERDIHAATRKFVDAEIIPHIGDWWEHESAPTRELMRKMGSLGLLGPTTPEQYGGAGTSYTAYGLICYELERADSGLRSAASVQGSLVMHPINEYGSEEQKKQWLPGLASGELIGCFGLTEPDGGSDPGGMRTRARKDGGDYVLNGSKMWITNSPLADVAVVWAKDDEDVVRGFIVPRDARGFSTPKIGHKMSLRASTTGEIVLEDCRIPAENLLPGSRGLKSPLGCLTSARSGIAWGAMGALESVLTASLEYAGSRTTFGRPIAARQLVQEKLAWMATQHSLGSLLAWRLGNLKDGGQMNYAQVSVAKGNNVRVALEGARMAREIHGGNGITTEYPVIRHMLNLETVDTYEGTHDIHTLIVGRDLTGQNALE

SEQ ID NO: 12480 - protein, 477 aa, Deinococcus radiodurans R1
MTATPQASARPERPFATVNPYTGETVKTFPFLESAEIPALIERADQAYREWGQRPVTERAAIMRRAAELMLERTDELASLITLEMGKLLREAKGEVALAASILNYYGEQGPSFLEPKTIPVPQGEAAVLHAPLGVLLGIEPWNYPLYQVVRFAAPNLVVGNTVLLKHSELCPQSALALEQLFHDAGVPQGAYTNLFLRIADIEQVIAHPAVQGVSLTGSERAGASVAELAGRHLKKCVLELGGSDPFIVLDAEDLDTTVKAAATGRLSNTGQACIAAKRLMVVDDLYDEFVSRLGQTFSAFVPGDPADPSTRLGPLSSEQAARDLQAQVQDAIDKGATVVAGGQRPEHPGAFVQPTVLTDVTPDMRAYHEELFGPVAVVYRVRDEDEAVALANASTYGLGGAVFSSDLDRAQRVAERLDTGMVWINHPTSSAADLPFGGVKRSGFGRELSSMGMLEFTNQKLVRAFPTKQKPAQVAG

SEQ ID NO: 12481 - protein, 339 aa, Fragaria x ananassa
RNLCPLNFTFAIHRLTMAAAPSESIPSVNKAWVYSEYGKTSDVLKFDPSVAVPEIKEDQVLIKVVAASLNPVDFKRALGYFKDTDSPLPTIPGYDVAGVVVKVGSQVTKFKVGDEVYGDLNETALVNPTRFGSLAEYTAAYERVLAHKPKNLSFIEAASLPLAIETAHEGLERAELSAGKSVLVLGGAGGVGTHIIQLAKHVFGASKVAATASTKKLDLLRTLGAADLAIDYTKENFEDLPEKFDVVYDAVGETDKAVKAVKEGGKVVTIVGPATPPAILFVLTSKGSVLEKLKPYLESGKVKPVLDPTSPYPFTKVVEAFGYLESSRATGKVVVYPIP

SEQ ID NO: 12482 - protein, 483 aa, Pseudomonas fluorescens
MKTKLFINNAWIDSSDQQTFEGKDPVNSEVMTERANATVTDAIKAAQVAEEAFKTWKDVGPSECRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFIPATHALITQCVQEAGMPAGVLNYLNSSPDRSPEIADALISAKEIRRINFTGSTRVGSIIAQKAAQHLKRCLLELGGKSPLIVLDDANIDAAVKAAVFGSFLFQGQICMYTERLVVDEKIADEFVSKFVEKTKRLSAGDLCVTGDCIIGPMVSLNSGYRINGLFKDAIDKGSKVVCGGMVQGAVMPSTILDHVKSDMRIYDEETFGPITVVIRCKGEAEAIRIANDSVYGLSSGVFGRDINRALRVGMSIEYGCVHINGSTVQNEVQAPYGGTKNTGYGRFDGRAVVDEFTELKWLTIEPFEQQYPF

SEQ ID NO: 12483 - protein, 442 aa, Arabidopsis thaliana
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAISCSNQEEDLEGTIVHQQNSSGNVNQKSNRTHGGPITNGTAAECLVLQ

SEQ ID NO: 12484 - protein, 240 aa, Ehrlichia ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 12485 - protein, 223 aa, Acinetobacter sp. ADP1
MINKIINDIEPILKSIPDGSTIMTSGFGTTGQPEALLEALIDFAPKELTIINNNASSGPNGLTQLFTAGLVKKLICSYPKSISSTVFPDLYRAGKIELELVPQGNLACRIQAAGAGLGAVFTPTGYGTKIAEGKETRIINGKNYVLEYPLEADYAFIYADKADRWGNLTYRKAARNFGPIMAKAAKTTIAQVNQTVELGDLDPECIITPGIFVQHVVRLGDIK

SEQ ID NO: 12486 - protein, 478 aa, Mycobacterium smegmatis
MAEKTSDDIFKLIKDENVEYVDIRFCDLPGVVQHFSIPASAFDESVFEDGLAFDGSSVRGFQSIHESDMMLLPDPNTARIDPFRAAKTLNMNFFVHDPFTREAYSRDPRNVARKAENYLASTGIADTAFFGAEAEFYIFDSVSFDSKINGTFYEVDSESGWWNTGEPFESDGSANRGYKVRPKGGYFPVAPYDHYVDLRDQMATNLQNAGFTLERGHHEVGTAGQAEINYKFNTLLAAADDVLLFKYIIKNTAWQAGKTVTFMPKPLFGDNGSGMHAHQSLWKDGQPLFHDESGYAGLSDIARHYIGGILHHAPSLLAFTNPTVNSYKRLVPGYEAPINLVYSQRNRSACVRIPITGNNPKAKRLEFRCPDSSGNPYLAFAAMLMAGIDGIKKKIEPLQPVDKDLYELPPDEAAAIPQAPTSLSAVIDKLEEDHEYLTEGGVFTEDLIETWISYKRENEIMPIQIRPHPYEFSLYYDV

SEQ ID NO: 12487 - protein, 339 aa, Solanum tuberosum
MAFLNKIGNILKHGVGKNTNLELSASNGSLFQTIRSMSSSKLFVGGLSYGTDESSLKETFSQYGEVIEARVILDRETGRSRGFGFISFPSSEEATSAMQAMDGQDLHGRRIKVNYATEKRRDGFGGGYGGGNYGGEGGNFAGGGGYAASNYGGGGGGFSGGYNSSGGGGYNSAGGSGYGSSSGYTYGGEGGNVAGSGGYPTNNYGGGGTEFSSGNSSAGGYSSYGGGSSNYGNNSSPVEGGNYGSSTPNINHSGQGSSFSGGYGGGNSGNDFVGAPSNNNSFANTGFGGSSEASYNGSQEQVSADQGTQSINEHLGQETPEGNYRDNDDKPKDYANTRG

SEQ ID NO: 12488 - protein, 444 aa, Streptomyces avermitilis
MVPHAGDARDAEAKHDARTRGWETTMSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 12489 - protein, 501 aa, Pichia pastoris
MSDNNQPLPPVSNSILEHIGKTPLVKLNRIPKILNLKPQVYAKVELFNSGGSIKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQLPVLKNDKLAGIVTLSQLLRLLSNKKIHLTSKVESAYFDFSKLENFEKSYNINKESTNKRREYQKITTSTTLAKLNKFFETSSAAIVENDKGQPIHIVSKVDLLSFLASKGEFN

SEQ ID NO: 12490 - protein, 168 aa, Schizosaccharomyces pombe
  misc_feature (1)..(1): Xaa can be any naturally occurring amino acid
XLLYKDVISGDELVSDAYDLKEVDDIVYEADCQMVTVKQGGDVDIGANPSAEDAEENAEEGTETVNNLVYSFRLSPTSFDKKSYMSYIKGYMKAIKARLQESNPERVPVFEKNAIGFVKKILANFKDYDFYIGESMDPDAMVVLMNYREDGITPYMIFFKDGLVSEKF

SEQ ID NO: 12491 - protein, 213 aa, Legionella pneumophila
ATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 12492 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKQSYYWYRNVVSNNWLETRR

SEQ ID NO: 12493 - protein, 488 aa, Mycobacterium leprae TN
MADPAGFLKYTQRELPRRRPVPLRLRDWKELYEEFDKETLRNQASRCMDCGIPFCHNGCPLGNLIPEWNDLVRRGRWHDAVERLHATNNFPDVTGRLCPAPCESACVLGINQDPVTIKQIELEIIDKAFDEGWVQPLPPQQLTGKTVAVVGSGPAGLAAAQQLTRAGHRVTVFERDDRIGGLLRYGIPEFKMEKRFLERRLDQLRAEGTEFRSGVNVGVDITADQLCADFDAVVLAGGAATWRELPIPGRELDGVHQAMEFLPWVNRVQEGDDVLGDDGQPPITAKDKKVVIIGGGDTGADCLGAVHRQGAIHVHQLEIMPRPPDARAASTPWPTYPLMYRVSPAHEEGGERVFSVNTEEFVGKNGRVHALKAHEVTMQDGRFVKVENSVFELEADLVLLAMGFVGPEKPGLLTDLGVKFTDRGNVARGADFDTSVPGVFVAGDMGRGQSLIVWAIAEGRAAAAAVDRFLMGATALPAPVKPSSLPLQ

SEQ ID NO: 12494 - protein, 157 aa, Mycobacterium leprae TN
MIVSFRPTADLVDSIGVDVRSCDLQFRQFGGCSEFAGPISTVRCFQDNALLKSVLSQTSAGGVLVVDGAGSLHTALVGDVIAELAHSNGWAGLIVNGAVRDAAALRGIDIGIKALGTNPRKSTKIGTGERHVEVNLGGVTFVPGEVVYSDDDGIVVV

SEQ ID NO: 12495 - protein, 322 aa, Mycobacterium leprae TN
MSVARIAYLGPEGTFTEAALLRMTAAGLVPDTGPDGLRRWPTESTPAALDAVRGGAADYACVPIENSIDGSVAPTLDNLAIGSPLQVFAETTLDVEFNIVVKPGITAADIRTLAAFPVAAAQVRQWLAAHLAGAELRPAYSNADAARQVAYGQVDAAVTSPLAATRWGLIALAAGIVDEPNARTRFVLVGMPGPPPARTGTDRTSAVLRIDNAPGMLVAALAEFGIRGIDLTRIESRPTRTELGTYLFFVDCVGHIDDGVVAEALKALHRRCADVCYLGSWPAGLATGPTVSPPPPDEASRWLARLRAGKPDQASEPGGGKL

SEQ ID NO: 12496 - protein, 336 aa, Mycobacterium leprae TN
MHAIVAESANQMVWREVPDVTAGPGEVLIEVAASGVNRADVLQVAGKYPHPPGASAIIGMEVAGVVAAVSSGVTEWSVGQEVCALLAGGGYAEYVAVPASQVMPIPKGVNVVDSAGIPEVACTVWSNLVMAAHLSAGQLLLLHGGTSGIGSHGIQVARALGAKVAVTAGSEEKLEFCRALGAQITINYRDEDFVARLQQQNGGADVILDIMGAAYLDRNIDALAIDGQLIVIGLQGGVKGELNLGKVLSKRARIIGSTLRARPVNGPNSKSEIVAAVTASIWPMIADGSVRPIIGARMAVQQAADAHQLLLSGKVSGKIVLTVAGSGTETLLSRHH

SEQ ID NO: 12497 - protein, 2116 aa, Mycobacterium leprae TN
METSVTPIAVIGMGCRLPGGINSPDKLWESLLRGDNLVTEVPPDRWDVDDFYDPEPGVPGRSVSRWGGFLDDVAGFDAEFFGISEREATSIDPQQRLLLETSWEAIEQGGLDPASLAGSSTAVFTGLTHEDYLVLTTAAGGLASPYVVTGLNNSVASGRISHTLGLHGPAMTFDTACSSGLMAVHLACRSLHDGESDLALAGGCAVLLEPHASVAASAQGMLSSTGRCKSFAADADGFVRSEGCAMVLLKRLPDALRDGNRIFAMILGTATNQDGGTETLMMPSEDAQVAVYQAALAVAGVEPETIGVVEAHGTGTPIGDPIEYRSLARVYGAGTPCALGSAKSNMGHSTASAGTVGLIKAILSLRNGLVPPLLHFDRLSDDLTEIETGLFVPQEVTPWPVGGYNTPKRVAVSSFGMSGTNVHVIVEEAPSEACAPDVPETSPGTGDATVGRQLFMLSSTSIAALRETARQLATWVEEHQDSVVLSDLAYTLARGRAHRPVRTAVVAADLPELVEGLCEIADGDALYDAVVGHGDRGPVWVFSGQGSQWASMGVQLLANEPVFAATITKLEPVIAAESSFSVTEAITAPETVTGIDKVQPSVFAVQVALATTMEQTYGVRPGAVIGHSMGESAAAVVAGALSLEDAARVICRRSKLMNRVAGSGAMGSVELPAKQVNSELMARGIDDVVISVVASPQSTVIGGATETVRDLIAQWEQRDVMAREVAVDVASHSSQVDPILDDLAAALADIAPMTPKVPYYSATLFDPRELPVCNGAYWVDNLRNTVQFAAAVQAAMEDGYRVFAELSPHPLLTHAVEQTARNLDMSVAALAGMRREQSMPYGLRGLLADLHSAGAALDFAALYPAGRLLDAPLPVWTHPRLFIDTDGQEQRAQGACTVTVHPLLGSHVRLLEEPERHIWQGDVGTAALSWLADHQVHNVAALPGAAYCEMALAAAVEVFGEAAEVRAIAFEQMLLLAAETPIDAIASVDAPGVINFVVQANQDGEKMRNATATLHAAEDDCPPPAYDIAALLEAHPNSVNGTDLRESFAERGVQLGAAFAGLATAHTAEAESGTVLAEVALPASIRFQQSSYQIHPALLDACFQSVGAGVDATKVGSRAGLLLPLGVRSLRVYRPTRNARYCYTRLTKIEPRGGEADLDVLDEHGAVLLAVRGLHMGTGTTERGELDRQLSERLLTIGWQQRTLPESVHVEPGSWLLIDTFNASAIPDMWASTLTDALKSYGTQGTECTNLSWLIQDDPVVSRERLGRQLRGRDGVVILCGPRAGAPDEQSLLAAREQVRHLVRIIRELAELEGELPRLFVVTRQAQIVQSGDAANLEQAGLRGLLRVISSEHPMLRTTLVDVDEHTDVERVAQQLLSGSEEDETAWRNGDWYVARLNPSPLSHEDRRTVVLNPEHDGLRVHVRKPGDLQSLELVASDRVPPGPGQLEVAVSMSSINFADVLIAFGRFPIIDDRDPQLGMDFVGVVTAVGEGVTGHQIGDRVGGFSEGGCWRTFLTCDANLAVTLPSGLTDEQAITAATAHATAWYGLNDLAGIKVGDKVLIHSATGGVGQAAISIARAKGAEIFATAGNPTKRAMLHDLGIEHVYDSRSVEFAEQIRRDTDGYGVDIVLNSLTGAAQRAGLELLTFGGRFVEIGKADVYGNTRLGLFPFRRGLTFYYLDLALMSVTQPDRVRELLATVFNLTADGVLTAPECTHYPLTDAANAIRAMSNAEHTGKLVLDIPRTGSRSVAVPPEQAPVYRRDGSYIITGGLGGLGLFFASKLAEAGCGRIVLTARSQPNPKARQTIERLCAAGADIVVECGNIAEPYTADRLVNAATATGLPLRGVLHSAAVVEDATLTNITDELIDRDWSPKVYGSWNLHCATIGQPLDWFCLFSSGAALLGSPGQGAYAAANSWVDLFAHWRRAQGLPVSAIAWGAWGEVGRATFLAEGGEIMITPDEGAYAFEMLVRYDRPYSGYIPILGAPWLPDLVRRSPWAEMFSSAGQGSRGPSKFRMELLALPQDEWSGRLRRLLVEQASVILRRTIDADRSFIEYGLDSLGMLEMRTHIESETGIRLTPKVIATNNTARALAQYLADTLAEEEGVAAPAAMVSPETP

SEQ ID NO: 12498 - protein, 213 aa, Mycobacterium leprae TN
MVFRRAAWHALLVAQSFSAINPGPTAELYLGDIKSVMLTQEQIQARIAELGAQIGHDYRDRSPASDQDLLLVTVLKGAVIFVTDLARAIPLPTQFEFMAVSSYGSSMSSSGVVRILKDLDRDIHDRNVLIVEDVVDSGLTLSWLLRNLATRRPQSLQVCTLLRKPDALRANVDITYVGFDIPNDFVVGYGLDYDERYRDLPYIGMLDPRVYQQ

SEQ ID NO: 12499 - protein, 447 aa, Mycobacterium leprae TN
MSPPTGRPRLSHDYKENLVPVIEQVGAREILDSRGNPTVEVEVVLIDGTFARAAVPSGASTGEYEAVELRDGDGRYGGKGVKRAVDAVLDEIGPVVIGLNANDQRLIDQELLDLDGTPDKSRLGGNAILGVSLAVAKAAADSAELPLFRYIGGSNAHILPVPMMNILNGGAHADTAVDVQEFMVAPIGAPSFVEALRWGAEVYHALKSVLKKKGLSTGLGDEGGFAPEVAGTTAALDLVTLAIEAAGFKPGADVALALDAAATEFYTDGIGYHFEGMTHTADQMTEFYADLLGSYPLVSIEDPLSEDDWDGWAALTASIGEQVQIVGDDIFATNPERLEEGIGRGVANALLVKVNQIGTLTETLEAVALAHHSGYRTMISHRSGETEDTMIADLVVALGSGQIKTGAPARSERVAKYNQLLRIEEELGDAARYAGDLAFLRYVVETR

SEQ ID NO: 12500 - protein, 304 aa, Mycobacterium leprae TN
MAKWTTADIPDQTGRVAVITGANTGLGYQTALALAEHGAHVVLAVRNLDKGKDAAARITATSAQNNVALQELDLASLESVRAAAKQLRSDYDHIDLLINNAGVMWTPKSTTKDGFELQFGTNHLGHFAFTGLLLDRLLPIVGSRVITVSSLSHRLFADIHFNDLQWECNYNRVAAYGQSKLANLLFTYELQRRLATRQTTIAVAAHPGGSRTELTRTLPALIAPIFSVAELFLTQDAATGALPTLRAATDAAVLGGQYFGPDGFAEIRGHPKVVASNGKSHDVDRQLRLWAVSEELTGVVYPVG

SEQ ID NO: 12501 - protein, 473 aa, Mycobacterium leprae TN
MRHYYSVAAIRDAEASLLASLPDGVLMKRAAYGLASVIIRELAVRTGGVTGRRVCAVVGSGDNGGDALWAATFLRRRGAAADAVLLNPDRVHRKALVAFRKAGGRIVENVSAATDLVIDGVVGISGSGPLRPAAAAVFATVSASGVPVVAVDLPSGIDVVTGVINGPAVHAALTVTFGGLKPVHALADCGDVTLVDIGLDLPDSDILGLQAADVAAYWPVPGVHDDKYTQGVTGVLAGSSTYPGAAVLCTGAAVAATSGMVRYAGSAYTQVLAHWPEVIASATPTAAGRVQSWVVGPGLGIDATATAALWFALETDLPVLVDADGLTMLAAHPDLVINRNAPTVLTPHASEFARLAGTPPGDDRVGACRKLADSFGATVLLKGNVTVIADPGGPVYLNPAGQSWAATAGSGDVLSGMIGALLAAGLPAAEAAAAAAFVHARAAALSAADPGPGDVPTSASRMVSHIRTALAAL

SEQ ID NO: 12502 - protein, 429 aa, Mycobacterium leprae TN
MPVTIDPRRHSAALFDLDAVVTDTPLDSTVTLVRQLQGIGVGTAVFSTNRNSQGVLTATGLDHLFPVHVDGLASGKVTILVAAANRLMAQPGRCVVVAVDAAGITAARYGGFALVLGLVIGEDQTGHRDTLRNSGADTVVADLGEVIVRTGDRRMSELPDALQTLGLTDDLTARQPAVFFDFDGTLSDIVDDPDSARPVPGATEALQKLATHCPVAILSGRDLADVIKRIGVPGIWYSGSHGFESTAPDGTHHQNDAAEATIPILEQAATQLRDQLGPIPGVMVEHKRFGVAVHYRNVARDRVNEVAVAVRTAGQRNALRVTTGREVIELRPDIDWDKGKTLHWVIDRLHHAGTQVGSASLMPICLGDDITDEDAFDAVRHTDVGGIPIVVRHTEDGNRATAALFTLDSPMHVSEFTERLARQLSDTQR

SEQ ID NO: 12503 - protein, 301 aa, Mycobacterium leprae TN
MRRFWRTVVEVTSQNSQALAQASGAFTLGGDLKVNRLGFGAMRLTGKGVWGPPVDRYEAVRVLRRAVELGVNFIDTADSYGPYVSEEIIAEALHPYKGLVIATKAGLLRTGRDVWIPLGNPSYLRQELEMSLRRLNVDTIDLFQLHRIDPNFPLADQVGELFTLKNEGKIRHIGLSEINLDQLTAAQQITEIVSVQNMYNLSARAAEPLLDAVTSRGIGFIPWSPLAAGPLAAPDGPLQRIAVNHHATPSQLALAWLLKRSPVMLPIPGTSRVAHLEENVAAAEISLSDDEFEMLSAAGAQ

SEQ ID NO: 12504 - protein, 446 aa, Mycobacterium leprae TN
MTSVEQSRQLVTEIPGPVSLELAKRLNAAVPRGVGVTLPVFVTRAAGGVIEDVDGNRLIDLGSGIAVTTIGNSSPRVVDAVRAQVADFTHTCFIITPYEEYVAVTEQLNRITPGSGEKRSVLFNSGAEAVENSIKVARSYTRKPAVVAFDHAYHGRTNLTMALTAKSMPYKSGFGPFAPEIYRAPLSYPYRDGLLNKDLATDGKLAGARAINVIEKQVGADDLAAVIIEPIQGEGGFIVPAEGFLATLLDWCRKNNVMFIADEVQTGFARTGAMFACEHDGIVPDLICTAKGIADGLPLAAVTGRAEIMNAPHVSGLGGTFGGNPVACAAALATITTIENDGLIQRAQQIERLITDRLLRLQDADDRIGDVRGRGAMIAVELVKSGTAEPDPELTEKVATAAHATGVIILTCGMFGNIIRLLPPLTISDELLAEGLDILSRILGDF

SEQ ID NO: 12505 - protein, 224 aa, Mycobacterium leprae TN
MGPLIAPSILAADFARLTDEAAVVASADWLHVDVMDGHFVPNLTIGLPVVQSLLAASDIPMDCHLMIDNPDRWAPPYAEAGAYNVTFHAEATDNPVGVAHDIRTAGAKAGIGVKPGTPLNPYLDILPHFDTLLIMSVEPGFGGQAFIPEVLSKVRTVRKMVDAGELTILVEIDGGINADTIEQAAEAGVDCFVAGSAVYGAADPSAAVAALRRRAGAVSPHLRR

SEQ ID NO: 12506 - protein, 416 aa, Mycobacterium leprae TN
MRIPNLKDLLEEGVSGRCVLVRCDLNVPLGDDGAITDLGRVTASVPTLKALLEAGAKIVVAAHLGRPKNGPDPKLSLEPVAAALGEQLGQNVQLVCSTDRSPVGGDALACVERLTDGDLLLLQNIRFDPRETSKVDDERLALAKQLVELVGSAGAFVSDGFGVVHRRQASVYDVATLLPHYAGILVADEIRILEQLTSSAKRPYAVVLGGSKVSDKLGVIESLATKADSIVLGGGMCFTFLAAQGFSVGKSLLETEMIETCRSLLDTYADVLRLPMDIVVTEKFVADSPPQTVAADAIPDGLMGLDIGPESVKRFATLLSNASTIFWNGPMGVFEFPAYAAGTRGVAEAIVAVTGKGAFSVVGGGDSAAAMRALSLPEGSVSHLSTGGGASLEYLEGKTLPGIEVLGREQPRGGDS

SEQ ID NO: 12507 - protein, 261 aa, Mycobacterium leprae TN
MSRKSLIAGNWKMNLNHFEAIALVQKIAFSLPDKYYDKVDVTVLPPFTDLRSVQTLVDGDKLRLTYGAQDLSQHDLGAYTGDISGAFLAKLGCSFVLVGHSERRTYHDEGDALVAAKTAAALKNSLTPIVCIGEYLEIREVGEHVSHCQNQLRGSLAGLSPEQIGNVVIVYEPVWAIGTGRVASAADAQEVCEAIRKELGALASPQVAETVRVLYGGSLNAKNIGDIVAQQDVDGGLVGGASLDGAQFATLAVIAAGGPLP

SEQ ID NO: 12508 - protein, 378 aa, Mycobacterium leprae TN
MARDYYGLLGVSRNASDADIKRAYRKLARELHPDINPDEAAQAKFKEISMAYEVLSDPEKRRIVDLGGDPMENAAASPSGFGGFGGLGDVFEAFFGGSSASRGPIGRVRPGSDSLLPMWLDLEECATGVTKQVTVDTAVLCDRCQGKGTNGDSAPIPCDTCGGRGEVQTVQRSLLGQMVTARPCPTCRGVGVVIPDPCCQCVGDGRVRARREITVKIPSGVGDGMRVRLAAQGEVGPGGGPAGDLYVEVHEQAHDIFVRDGDDLHCTVSVPMVDAALGTTITVDAILDGMSEIDISPGTQPGSVIELRGQGMPHLRSNTRGNLHVHVEVMVPTRLDQHDTELLRELKRRRSRDVAEVRSTHAAGGGLFSRLRETFTNR

SEQ ID NO: 12509 - protein, 229 aa, Mycobacterium leprae TN
MITLDHVSKKYKSLARPALDNVNVKIDKGEFVFLIGPSGSGKSTFMRLLLGAETPTSGDVRVSKFHVNKLPGRHIPRLRQVIGCVFQDFRLLQQKTVYENVAFALEVIGRRSDAINQVVPDVLETVGLSGKANRLPDELSGGEQQRVAIARAFVNRPLVLLADEPTGNLDPDTSKDIMDLLERINRTGTTVLMATHDHHIVDSMRQRVVELSLGRLVRDEWCGIYGMDR

SEQ ID NO: 12510 - protein, 310 aa, Mycobacterium leprae TN
MSIAEDVTQLVGNTPLVRLRRVTEGALADVVAKLESFNPANSVKDRIGVAMIDTAEEAGLIKPDTVILEPTSGNTGIALAMVCAARGYHCVLTMPETMSIERRMLLRAYGAELILTPGADGMSGAIAKAEELAKSDKRYFIPQQFENPANPAIHAATTAEEVWRDTDGKVDIFVSGIGTGGTITGVARIIKERRPATQFVAVEPAASPVLSGGQKGPHPIQGIGAGFVPSVLVLDLVDEIVTVGNEEALDLARRLAKEEGLLVGISAGAAVCAALHVARRPENTGKLIVVVLPDFGERYLSTMLFADLAN

SEQ ID NO: 12511 - protein, 478 aa, Mycobacterium leprae TN
MTEKTSDDVLKLAKDENIEFVDVQFCDLPGIMQHFTIPASAFDKSVFEDGLAFDGSSIRGFQSIHESDMLLFPDPDTARIDPFRAAKTLNVNFFVHDPFTLEPYSRDPRNIARKAENYLISTGIADTVYFGAEAEFYIFDSVSFDSRSNGSFYQVDAISGWWNTGAATESDGSPNRGYKVRHKGGYFPVAPNDQYVDLRDKMLTNLTNAGFVLEKGHHEVGTGGQGEINYQFNTLLHAADDMQLYKYIVKNTAWQNGKTVTFMPKPLFGDNGSGMHTHQSLWKGGTPLMYDEIGYAGLSDTARHYIGGLLHHAPSLLAFTNPTVNSYKRLVPGYEAPIKLVYSQRNRSACVRIPITGKNPKAKRLEFRCPDASGNPYLAFSAMLMAGLDGIKNKIEPQAPVDKDLYELPPEEAADIPQAPTQLAAVIDRLEEDHDYLTEGSVFTPDLIETWINFKRENEIEPVNIRPHPYEFALYYDV

SEQ ID NO: 12512 - protein, 476 aa, Mycobacterium leprae TN
MLLASLNPSVVTATDIADAVCVDGVVLSRSGLVGAATSVAERVGGARLVAVLATPTASTVLAITGCLIAGVPVVPVPADIGVVERRHMLTDSGAQAWLGPGPSADSAPDGLPHIPVQLDARSWNRYPEPSPDATAMVIYTSGTTGPPKGVLLSRRAIAVDLDALAQAWQWTADDVLVHGLPLFHVHGLVLGLLGSLRIGNRFVHTGKPTPTAYAQACSEAGGSLYFGVPTVWSRLVADEAVARALRPARLLVSGSASLPVPVFDRLAHLTGHRPIERYGSTESLITLSTLADGERRAGWVGLPLAGVQTRLVDESGGPVPYDGETVGRLQVRSPTMFGGYLNRPEATAEAFDEDGWYRTGDVAVVDSGGMHRIVGRESVDLIKLGGYRIGAGEIEMALLGHPDVREVAVVGLPDEDLGQRIVAFVVGAEALDADELINYVAQQLSIHKRPREVRFVDALPRNAMGKVLKKQLLFEG

SEQ ID NO: 12513 - protein, 115 aa, Mycobacterium leprae TN
MTLDPDIAVRLKRNAEGLFTAVVQERSSGDVLMVAWMDDQALARTLETREANYYSRSRAEQWIKGSTSGNTQHVHSVRLDCDGDTVLLTVDQVGGACHTGAHSCFDSAMLLAPQD

SEQ ID NO: 12514 - protein, 270 aa, Mycobacterium leprae TN
MMVLEQSETSRLGPVFDSCRADNRAALIGYLPTGYPDVPTSVDAMIELVESGCDIIEVGVPYSDPGMDGPTIARATEVALRGGVRVRDTLAAVEAISQAGGRAVVMTYWNPVLRYGVCAFARDLESAGGHGLVTPDLIPDEARQWIAASEKHRLDRIFLVAPSSTPHRLVTTVGASRGFVYAVSVMGVTGARDAVSQVVPELVARVKAVSDIAVGVGLGVRSREQAAQIGGYADGVIVGSALVSALGDGLPRLRALAEELAAGVRQRTFM

SEQ ID NO: 12515 - protein, 472 aa, Mycobacterium leprae TN
MTRRGKIVCTLGPATQSDELIRALVEAGMDVARMNFSHGDYSDHKAVYDRVRVASDATGRAVGVLADLQGPKIRLGRFATGSTYWADGETVRITVADCHGSHDRVSTTYKNLARDAVVGDRVLVDDGKVGLVVSAIDGDDVVCTVTEGGPVSNNKGMSLPGMHVSAPALSDKDIEDLTFALNLGADLVALSFVRSPSDVELVHKAMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADALMLSEETSVGKYPLAAVKTMSRIVCAVEENSTAAPPLTHVPRTKRGVISYAARDIGERLDAKALVAFTQSGDTVRRLARLHTPLPLLAFTAWPEVRSQLAMTWGTETFLVPKMLSTDGMIRQVDKSLLELGRYKRGDLVVIVAGTPPGTVGSTNLIHVHRIGEDDV

SEQ ID NO: 12516 - protein, 498 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVKSSD

SEQ ID NO: 12517 - protein, 505 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 12518 - protein, 404 aa, Mycobacterium leprae TN
MTPTQTNTATMQQRWETVMMNNYGTPPIVLASGNGAVVTDVDSNTYLDLLGGIAVNVLGHRHPAVIEAVTHQITTLGHTSNLYATEPSITLAEELVALLGADTQTRVFFCNSGTEANELAFKLSRLTGRTKLVAAQAAFHGRTMGSLALTGQPAKQAAFEPLPGHVTHVPYGQVDALAAAVDNDTAAVFLEPIMGESGVIVPPEGYLAAARDITTRHGALLVIDEVQTGIGRTGAFFAHQHDSITPDVVTLAKGLGGGLPIGAFLATGPAAELLTLGLHGSTFGGNPVCTAAALAVLRVLATQGLVRRAEVLGDSMRIGIESLSHPLIDQVRGRGLLLGIVLTAPRAKDIEKAARDAGFLVNATAPEVIRLAPPLIITESQIDSFITALPGILDASIAELGKKA

SEQ ID NO: 12519 - protein, 367 aa, Mycobacterium leprae TN
MSPFGRVSATLPVFPWDTLADAKAVAESHPDGIVDLSVGTPVDPVAPLIQEALAAASSVAGYPTTAGTARLREAAVAALDRRYGITGLTEAAVLPVIGTKELIAWLPTLLGLRAGDVVVVPELAYPTYNVGARLAGARVLRADSLTQLGLQSPALFYLNSPSNPTGQVLAVNHLRKMVGWARNRGVVVVSDECYLGLGWDAEPFSVLHPLVCDGNHTGLLAVHSLSKSSSLAGYRAGFVAGDPDLVAELLAVRKHAGMMVPTPVQAAMVAALGDDAHEREQRDRYARRRDVLLPAVVSAGFTVDHSEAGLYLWASRGEPCRDSVEWFAQRGILVALGEFYGPGGCQHVRVALTASDERIAAVVARLS

SEQ ID NO: 12520 - protein, 448 aa, Mycobacterium leprae TN
MDRQKEFVLRTLEERDIRFVRLWFTDVLGYLKSVAIAPAELEGAFEEGIGFDGSSIEGFARVSESDTVAHPDPSTFQILPWATTAGHHHSARMFCDITMPDGSSSWADPRHVLRRQLTKANDLGFSCYVHPEIEFFLLKAGPEDGSMPIPVPVDNAGYFDQAVHDSALNFRRHAIEALEFMGISVEFSHHEGAPGQQEIDLRFADALSMADNVMTFRYVIKEVAIENGARASFMPKPFAQHPGSAMHTHMSLFEGDVNAFHSDDDPLQLSDVGKSFIAGILEHASEISAVTNQWVNSYKRLVVGGEAPTTASWGAANRSALVRVPMYTPHKTSSRRVEVRSPDSACNPYLAFAVLLAAGLRGVEKGYVLGPQAEDNVWDLTPEERLAMGYRELPTSLDSALGAMEVSEFVAEALGEHVFDFFLRNKRAEWANYRSHVSLYELKTYLSL

SEQ ID NO: 12521 - protein, 473 aa, Mycobacterium leprae TN
MTITAPKVVGKSIDPRDPLLRLSNFFDDGRVEPLHERNQSGVFAATGTVNGLRTIAFCTDGTVMGGAMGIEGCAHIVNAYDTAIEEQSPIVGIWHSGGARLAEGVRALHAVGQVFEAMIRASGYIPQISVVVGFAAGGAAYGPALTDVVIMAPEGRVFVTGPDVVRSVTGEDVDMASLGGPETHHKKSGVCHIVANDELDAYERGRRLVGLFCQQGHFDRSKAEAGDTNIQALLPESSRRAYDVHPVVTAILDENTPFDEFQANWAPSMVVGLGRLSGRTVGVLANNPLRLGGCLNSESAEKAARFVRLCDAFGIPLVVIVDVPGYLPGVDQEWGGVVRRGAKLLHAFGECTVPRVTLVTRKTYGGAYIAMNSRSLNATKVFAWPDAEVAVMGAKAAVGILHKRKLAAAPNDEREALHDDLAAEHERIAGGVDSAIDIGVVDEKINPAHTRSKLTEALAQSPVRRGRHKNIPL

SEQ ID NO: 12522 - protein, 362 aa, Mycobacterium leprae TN
MKSHVSKHRRKRRLGAMTTVSAYAATSATEPLTKVTINRRAPGPHDVAIQIKFAGICHSDIHTVKAEWGQPNYPVVPGHEIAGVVTAVGTEVTKHKVGDRVGVGCMVGSCGECSSCLAGIEQYCKRGATFTYNSIGTDGQSTQGGYSQAIVVDENFVVHIPDALPLDAAAPLLCAGITLYSPLRHWNAKPGTRLAIIGLGGLGHMGVKLGRKMGCEVTVLSQSLKKMEDGLQLGASNYYATADPDTFRKLRGSFDLILNTVSANLDLGKYLNLLDVNGTLVELGIPEHPMLVPAFALALMRRSLAGSNIGGITETQEMMNFSAEHSVTPEIELIEPDYINEAYERVLASDVRYRFVINISSL

SEQ ID NO: 12523 - protein, 361 aa, Mycobacterium leprae TN
MSQTVRGVISRKKDEPVELVDIVIPDPGPGEAVVDVTACGVCHTDLTYREGGINDRYPFLLGHEAAGTVEVVGPGVTAVEPGDFVILNWRAVCGQCRACKRGRPSYCFDTFNAQQKMTLIDGTELTPALGIGAFADKTLVHSGQCTKVDPAADPAVAGLLGCGVMAGLGAAINTAAVSRDDTVAVIGCGGVGDAAISGAALVGANRIIAVDIDDTKLEWARTFGATHTVNALELEVVKTIQDLTSGFGVDVVIDTVGRPETWKQAFYARDLAGTVVLVGVPTPDMRLDMPLLDFFSHGGSLKSSWYGDCLPERDFPTLVDLYLQGRLPLGKFVSERIGLGDVEEAFHKIHGGKVLRSVVML

SEQ ID NO: 12524 - protein, 181 aa, Mycobacterium leprae TN [sequence omitted]

SEQ ID NO: 12525 - protein, 338 aa, Mycobacterium leprae TN
MPMGVAIEVKGLTKSFGSSRIWEDVTLDIPAGEVSVLLGPSGTGKSVFLKSLIGLLRPERGSILIDGTDIIECSAKELYEIRTLFGVLFQDGALFGSMNLYDNTAFPLREHTKKKESEIRDIVMEKLQLVGLGGDEKKFPGEISGGMRKRAGLARALVLDPQIILCDEPDSGLDPVRTAYLSQLIMDINAQIDATILIVTHNVNIARTVPDNMGMLFRKHLVMFGPREVLLTSDEPVVRQFLNGRRIGPIGMSEEKDESTMAEEAALLEAGHYAGGAEEVEGVPPQITVTPGMPKRKAVARRQARVRAMLPTLPKGAQAAILDDLEGAHNYQAHEFGD

SEQ ID NO: 12526 - protein, 335 aa, Mycobacterium leprae TN
MHAWRVRRPGPIQTSPLEWVTTEVPCPEPSELLVAVRACGVCRTDLHVAEGDLPVHREHVTPGHEVVGEVLGVGSDVDAAAGFDVGDRVGIAWLRYTCGVCNYCRSGTENLCVQSRYTGWDVDGGYAEFTTVPAAFAHHLPSGYSDCELAPLLCAGIIGYRSLLRSELPPGGRLGIYGFGGSAHIAAQVALVQGAEVHVMTRGARAQELALELGAASAQGVADLPPVPLDAAIVFAPVGDLVLPACEALNRGGTLAIAGIHLSDIPQLNYQRHLFQERQIRSVTSNTRADARAFLDFAAQHHIAVTTPEYPLEQADQALTDLSVGRISGAAVLLA

SEQ ID NO: 12527 - protein, 483 aa, Mycobacterium leprae TN
MSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 12528 - protein, 478 aa, Mycobacterium leprae TN
MRFLDGHQPRFDLTYKDVFIVPHRSDVASRFDVDLSTYDGSGTTIPVVVANMTTVAGQRMAETVARRGGLVILPQDLPIATVQQAVEFVKSRDLVIDTPVLLTPNDSVSDATTLIHKRAHGVAVVAFEGRPIGLVRESSCLGVDRFTRVRDVATTDFVTAPVGTDPRKIFDLLEHAPIDVAVLTNADGTLAGVLTRTGAIRAGIYTPATDARGRLRIGAAVGINGDVAGKAQSLAEAGVDVLVVDTAHGYQVKTLEAIKCVASLNLGVPLVAGNVVSAEGTRELLNAGATIVKVGVGPGAMCTTRMMTGVGRPQFSAVLECASAARKLNRHVWADGGVRHPRDVALALAAGASNVMIGSWFAGTYESPGDLMRDRHDQPYKESYGMASKRAVVARTVADSSFDRARKALFDEGISTSRMGLDPDHGGVEDLIDHITSGVRSTCTYVGASTLAELHEKAVVGVQSAAGFAEGHPLPSGW

SEQ ID NO: 12529 - protein, 368 aa, Mycobacterium leprae TN
MLLPTLERILDGRAPAMVVVPAQHEPIAALRALRVGEEIDDDVALVATTSGTTGVPKGALLTAAALTASASATHDRLGGPGSWLLALPPYHIGGLQVLVRSVLAGSVPIELDISAGFDLAKLPDAVGRLGTGRRYTSLVATQLAKALTDSTATAVLAELDAVLVGGGPAPRPILDAATSAGIMVVGTYGMSETAGGCVYDGVPLDGVCIRVLVNGHVAIGGATLAKGYRNPIVPDPFAESGWFHTDDLGTVDGSGVLTVLGRADDAISTGGLTVLPGPVEAALCTHPAVSDCAVFGLTDDRLGQRVVAAVVLTDGYATPTLSMLRAHVTRRLDAMAAPRELHIVDTLPRRGIGKVDRTALVRRFAKSG

SEQ ID NO: 12530 - protein, 2201 aa, Mycobacterium leprae TN
MTASTPDRRAIITEALHKIDDLTARLEIAEKSSTEPIAVIGMGCRFPGGVNNPEQFWDLLCDGRSGIVRVPSDRWDADAYYTDDHTVPGTICSTEGGFLTGWQPDEFDAEFFSISPREASAMDPQQRLLIEVAWEALEDAGVAPHTIRGTQTSVFVGVTAYDYMLTLAGRLRPEDLDAYIPTGNSANFAAGRLAYILGVRGPAVVIDTACSSSLVAVHLACQSLRHRESDAALVGGTNLLLSPGPSIACSRWGMLSPAGQCKAFDVSADGYVRGEGAGVVVLKRLDDAVRDGNRILAIVRGSAVNQDGASSGVTVPNGPAQQELLRTALASSKLTAADIDYIEAHGTGTPLGDPIELDSLSKVFSDRQSRRGSVPLVIGSVKTNLGHLEAAAGIAGFIKAVLAVQRGFIPRHLNFHQLTTHASEAASRLNIASEGLEWPTVGRPRRAGVSSFGVSGTNAHVVLEQAPDPVAVPAPGPALRLVPAVSTLVVSGKTVQRVAATASVLADWMEGPGAAVPLTDVAHTLNHHRARHTKFGTVAAVDRGQAVAGLRALAAGQSTSGVVAPRDSVVGPGTVFVYSGRGSQWAGMGRQLMADEPAFAEAIAKLEHEFVVQAGFSLHEVIANGKELVGIEQIQLGLMGMQLALTELWRSYGVEPDAVIGHSMGEVAAAVVAGALTPTQGLRVTATRSRLMAPLSGQGTMALLELDAVATEALIADYPQVSLGIYASPRQTVIAGPTAMIDALIDKVRQQDGFATRVNIEVAPHNPAMDALQPQMRSELADLTPQQPTIPIISTTYEDFGSTPVFDVEHWATNMRNPVRFQQAITHASSGVGGDYHTFIEISAHPLLTHSISDILCSIAGTAEENAVGAGYLSIGTLQRDAHDTLEFHTNLNATHTSRPPRTPHPPEPHPVLPITPWQHTRHWISAMSAAYHRADTHPLLGVGVTDPTSGTRVWESQLGPDLLWLGDHVIDDLCVLPGAAYAEVALAAATDTFPNERVEGDQPWMIYELDLHQVLHVTEGTVLVTTLTGDQQRCRIEMRTRNGFSGWTTHATATVGPAESVQPSDREERTATPVDVVDELGPEDLYQRLCSAGQQHGPAFQGIVGLAVEESGAARAEVRLPSSARMGFRDFLLHPVMMDIALQTLGATRMATDLAGGPTARKTLVLPVRFAGVHVYGDVTRGVCAVGLLTATEGLDRLVGEVVLTDLDGQPLLVIDEVQMTVLGAGSDATELTDRLFTLEWEPTPLYKEVSRSSAQGGLLLIGDVAAGDPLLLALQSSLRARLSENGPPPVDCVSFSDEVKLQAAITRTDISWDGIVVVCPPRASDESLPDDAQLELAQTRTLQIAGVVQAVTQMGARKSPRLWIVTRGAQQLNAGESVTLAQTELRGIVRVLTFEHSELKATLLDIEADGTDSLDDLTEELLAGSNHDEVAYRDGQRYVNRLVPAPITPKGELAGETRRKVVELGGLGAVQLQIDQPGRLDALTVHQVKRGEPEGDQVEVRVVAAGLNFSDVLKAMGVYPGLDGGAPAIGGECVGYVTAIGDDVDSVEVGQRVIAFGPGTFGTYVGTIADLVVPIPDTLSDHEAATFGVAYLTAWHCLCEVGRLSPGERVLIHSATGGVGMAAVSIAKMLGARIYTTAGSDAKRQMLSELGVEYVGDSRSVDFADEILELTHGYGVDIILNSLADKAIQRGVQILAPGGRFIEIGKKDVYDDANLGLAALAKSASFSVVDLDLNLKLHPARYRQLLQHILAHVADGRLPVLPVTEFSLHNAADAFRLMASGKHTGKIVISIPYEGNIEAIASPPPVPLVSQDGGYLVVGGMGGLGFVFARWLAEQGAGLIVLNGRSSPSDDVTAAIADLTAAGHRIEVVTGDISEPGTADRLVHAVQSAGFRLAGVLHSAMVLADEIMLNMTDSAARRVFVPKVTGSWRLHQATAAFEVDWWLTFSSASSLLGTPGQGAYAAANAWVDGLVAYRRSLGLPAVGINWGPWAEVGRAQFFAGLGVSLLTAEQGLAAMQTVLAADRAQTGVFSLDARQWFQSFPAVAGSSLFANLRDTATLKSGERRGVGKIRAQLDVLDAAERPGHLASAIADEIRAVLRSSDPIDHDRPLEALGLDSLMGLELRNRLEASLGITLPVALVWAYPTTADLAAALCERMDYALPAEVQEATDTNAELSKAEMDLLSDLVEASELEAATRGES

SEQ ID NO: 12531 - protein, 467 aa, Mycobacterium leprae TN
MTHYDVVVLGAGPGGYVAAIRAAQLGLSTAVVEPKYWGGICLNVGCIPSKVLLHNAELAHIFTKEAKTFGISGDASFDYGIAYDRSRKVSEGRVAGVHFLMKKNKITEIHGYGRFTDANTLSVELSEGVPETPLKVTFNNVIIATGSKTRLVPGTLLSTNVITYEEQILTRELPDSIVIVGAGAIGIEFGYVLKNYGVDVTIVEFLPRAMPNEDAEVSKEIEKQFKKMGIKILTGTKVESISDNGSHVLVAVSKDGQFQELKADKVLQAIGFAPNVDGYGLDKVGVALTADKAVDIDDYMQTNVSHIYAIGDVTGKLQLAHVAEAQGVVAAEAIAGAETLALSDYRMMPRATFCQPNVASFGLTEQQARDGGYDVVVAKFPFTANAKAHGMGDPSGFVKLVADAKYGELLGGHMIGHNVSELLPELTLAQKWDLTATELVRNVHTHPTLSEALQECFHGLIGHMINF

SEQ ID NO: 12532 - protein, 464 aa, Mycobacterium leprae TN
MRIAQHISDLIGGTPLVRLNSVVPAGTGVVAAKVEYFNSGGSSKDRIAAKMIDAAEASGQLKPGGTIVEPTSGNTGVGLALVAQHRGYKCVFVCPDKVSEDKRNVLLAYGAEVVVCPTAVPPDDPDSYYSVSDRLVAKIDGAWKPDQYANPAGPASHYETTGPEIWADTDGRVTHFVAGIGTGGTITGVGRYLKEVSGGLVRIIGADPEGSVYSGGTGRPYLVEGVGEDFWPAAYDPMVPDQIIAVSDSDSFNMTRRLAREEAMLVGGSCGMAVVAALQVAEEAGPAALVVVLLPDGGRGYMSKIFNDAWMSSYGFLRSRLDGSTEQPIVGDVLRRKSGALPDLVHTHPSETVRDAIGILREYAVSQIPVVGAEPPVMAGEVVGSVSERELLSAVFEGRASLADAVSEHMGPPLRLIGDGELVSVAGEALRDSDALMVVEKGKLVGVITRYDLLGFLSEGAPLR

SEQ ID NO: 12533 - protein, 446 aa, Mycobacterium leprae TN
MGSTDQATAPAGPAVSISAKLFEDACAVIPGGVNSPVRAFSAVGGTPLFITEARGCWLTDADGRRYVDLVCSWGPMILGHAHPAVVDAVATVAASGLSFGAPTPAETQLAAEIIGRMAPVERIRLVNSGTEATMSAVRLARGFTGRTKIIKFSGCYHGHVDALLADAGSGVATLSLPSSPGVTGAAAADTIVLPYNDIEAVRQTFARLGDQIAAVITEASPGNMGVVPPAPGYNAALRAITAEHGALLIIDEVMTGFRVSRSGWYGLDPVAADLFIFGKVMSGGMPAAAFGGRAEVMERLAPLGPVYQAGTLSGNPVAMAAGLATLRAAADAVYATLDRNADRLVAMLSEALTDAGVPHQIPRAGNMFSVFFSEAPVTDFASACNSQVWRYPAFFHALLDAGVYPPCSTFEAWFVSAALDDAAFGRIVDALPGAAAAAVAARHRES

SEQ ID NO: 12534 - protein, 247 aa, Mycobacterium leprae TN
MQQGNTATLILLRHGESDWNARNLFTGWVDVGLTDKGRAEAVRSGELLAEHNLLPDVLYTSLLRRAITTAHLALDTADWLWIPVRRSWRLNERHYGALQGLDKAVTKARYGEERFMAWRRSYDTPPPPIEKGSEFSQDADPRYTDIGGGPLTECLADVVTRFLPYFTDVIVPDLRTGRTVLIVAHGNSLRALVKHLDEMSDDEVVGLNVPTGIPLRYDLDADLRPVVPGGTYLDPEAAAAVISQARP

SEQ ID NO: 12535 - protein, 501 aa, Mycobacterium leprae TN
MLSRRAVGSCGKEEALMITESVAQKTAVSKSGVPPHTPPGVNSEATVVRLRQTFASGRTRSVDWRTQQLRALQALMVENEGAIAQALADDLDRNPVEAFIVDIAATVSEAKYAAKKVRKWMRRKYRFLEVSQLPGRGWVEYEPYGTVLIIGAWNYPFYLTLVPAVGAIAAGNTMVLKPSEVAAASAHLMAELVPRYLDNDAIAVIEGGGAVSQELIAQGLDRVMFTGGTEIGRKVYEGAASHLTPVTLELGGKSPVIVAVDADIDVAAKRIAWIKILNAGQTCVAPDYVLAAAPIRDELVNKIGFAIAKFRSQDDPSGMRIVNQRQFDRLCGYLAGVQSAAGGKGVVVVGGKCDASTLRIQPTVIVDPDPEGPLMTKEIFGPILPVLTVQSLDEAIGFINARPKPLAAYLFTKSRKTRDRVIKEVSAGGMLVNHLAIQVLTAKLPFGGVGESGIGAYHGKWGFDEFSHRKSVLTKPTRPDLSSFIYPPYTERSFRLAHRLF

SEQ ID NO: 12536 - protein, 484 aa, Chlamydophila pneumoniae J138
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVNAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 12537 - protein, 440 aa, Chlamydophila pneumoniae J138
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAKDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 12538 - protein, 229 aa, Chlamydophila pneumoniae J138
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYQGFTVQSFLPHTIEKIAFARHAIKTLGLKDSCLIEVDGGIDQQSAPLCRDAGADILVTASYLFEADSLAMEDKILLLRGENYGVK

SEQ ID NO: 12539 - protein, 397 aa, Chlamydophila pneumoniae J138
MRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 12540 - protein, 428 aa, Chlamydophila pneumoniae J138 [sequence omitted]

SEQ ID NO: 12541 - protein, 461 aa, Chlamydophila pneumoniae J138
MTQEFDCVVIGAGPSGYVAAITAAQSKLRTALIEEDQAGGTCLNRGCIPSKALIAGANVVSHIKHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 12542 - protein, 228 aa, Chlamydophila pneumoniae J138
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQHGKNVFVSAHGNSLRSLIMDLEKLSEEEVLSLELPTGKPVVYQWKNHKIEKHPEFFG

SEQ ID NO: 12543 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 12544 - protein, 390 aa, Xylella fastidiosa 9a5c
MGAQRVQGGYGRIDAFYHCCSFMSQREWVASSICKIEADFNRSVDTHLIPLQLPGFPDIDFYLKDESIHPTGSLKHRLARSLFLYALVNGWLSPGRPVIEASSGSTAVSEAYFARLLGLPFIAVIPTSTSPEKVAAIEFHGGRCHAVERACDLHDAAHQLARETGGHFMDQFTYAERATDWRANNNIAESIFKQMADEPHPIPSWIVCSPGTGGTAATLGRYVRYRRHVTRILCADPEISVFFDHYRAACKGSDHRNNVTDTGGSRVEGIGRPRLEPSFIHDCIDAMIKVPDALSLAAMRYISARLGRRVGGSTGTNMVGVLQTAARMRAEGMKGSIVTILCDGGERYAHSYYSPAWYAAHGIDVSDSDAMIAAVVAGDTLPLLPCAALG

SEQ ID NO: 12545 - protein, 285 aa, Xylella fastidiosa 9a5c
MTTNDSWFTEHFQATGSAIGFRITGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMTDCPTNSVDVIIVDSTDPVGPAKGLFNRTFYESCFRALKNDGLLVQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 12546 - protein, 486 aa, Xylella fastidiosa 9a5c
MMHHNVHQSEILADPCDLQRAERWLQRDLRVLWHPCTQMREHPDTLPLVPIVRGEGAWLVGHDGRRYLDAVSSWWTNLFGHADPRISAAIAAQARTLEQVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEVLFKRYSGQICALILEPLLQCAGGMRMHHPVYLHRVRELCDAHGALLICDEIATGFGRTGTLFACEQACPVILTDTDDKQLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQAGMVVAFELTRDGNKRTPFPLQARLGLHVYRAALARGVILRPLGDVVYWMPPYCVDEEQLHLLAETTRVAIDEAIACV

SEQ ID NO: 12547 - protein, 239 aa, Xylella fastidiosa 9a5c
MILAQVSGHSLSSERFMSNCLIAPSILSADFARLGAEVDAVLAAGADWIHFDVMDNHYVPNLTFGPMVCKALRSYGITAPIDVHLMVEPVDRIVPDFTQAGASMISFHMEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHAPDYGDVIAHMRAAVAAVR

SEQ ID NO: 12548 - protein, 502 aa, Xylella fastidiosa 9a5c
MHNGFDALQLHANRLRGVTIPDLLAAELKRPEQYARQVGPLYFNFARQKYDCVALEALFALARNHNVAGAFQRMFCGEQVNVTEGRAVLHTALRGDLSGTSVAVAAYTAAAKVRERMYALIAGLDASEVTDIISVGIGGSDLGPRLVVDALRPISQGRFRVHFVSNVDGAAMRRTLDMLDPSRTAGILISKTFGTQETLLNGRILYDWLGGSERLYAVSANPERAAHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDPYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 12549 - protein, 482 aa, Xylella fastidiosa 9a5c
MLPTSHTPCMESAPPMNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDEAAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFENSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIIVSGTAEVTRGSEILLLTENQSTYIPLGVTHRLRNPGKLPLELIEVQSGSYLGEDDIVRFEDTYGRT

SEQ ID NO: 12550 - protein, 198 aa, Xylella fastidiosa 9a5c
MPLFFSIWSELMRLVLLGPPGSGKGTQAAQMKETLQIPHISTGDLLRSEVVAGTPLGLQAKQVMAQGDLVSDAILIGMLESRLSHTDVVKGFILDGYPRNLSQAAALDGLLAKLGHPLNAVVQLEVPTDVLVERIAGRAQAEGREDDTPDAVRKRLQVYNDSTAPVIGFYQQRGILLRVDGVGRLDEVSQRIVVALGC

SEQ ID NO: 12551 - protein, 249 aa, Xylella fastidiosa 9a5c
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 12552 - protein, 402 aa, Xylella fastidiosa 9a5c
MKLTDLSNPAFLENPYPLYETLRAQAPFVSIGPNALMTGRYSLVDSLLHNRNMGKKYMESMRVRYGDSAADMPLFQAFSRMFITINPPAHTHLRGLVMQAFTGRESESMRPLAIDTAHQLIDNFEQKPSVDLVAEFAFPFPMQIICKMMDVDIGDAVTLGIAVSKIAKVFDPSPMSADELVHASTAYEELAQYFTKLIELRRTHPGTDLISMFLRAEEDGEKLTHDEIVSNVIMLLIAGYETTSNMIGNALIALHRHPEQLALLKSDLSLMPQAVSECLRYDGSVQFTMRAAMDDIEVEGELVPRGTVVFLMLGAANRDPAQFTHPDQLDITRKQGRLQSFGAGIHHCLGYRLALIELECALTTLFERLPHLRLAHLDALNWNQRSNLRGVNTLIVDLHAKN

SEQ ID NO: 12553 - protein, 190 aa, Xylella fastidiosa 9a5c
MIDPDGYRPNVGIVLMCRDGQVFWGRRVRLDGWQFPQGGMHSDETPVEAMYRELNEETGLLPEHVQLLGATPGWLRYRLPSQAVRCNRSQMCIGQKQVWFLLQLIGDESHVQLDQSENPEFDHWRWVSFWYPIEHVVMFKRGVYARALCQLASLAQQVVGLEVGTMPQYVQDICLLNVGYKHLPNWVSRY

SEQ ID NO: 12554 - protein, 264 aa, Xylella fastidiosa 9a5c
MILPTPAVQLSGVRIERGGRTVLRNVALQVPRGSITTVLGPSGSGKSTMLAALTGELRPTEGEVRLFGDGIPQGPQALLEMRRNLGVLLQGNGLLTDLSIAENVALPLRAHTRMPEPLLQRLVLMKLHAVGLRAVAEAMPRELSGGMARRVALARALALDPPLMIYDEPLTGLDPIASGVIVSLIKRLNDSLGLTTIIVSHHVHETLPICDQAVVIANSTVIFAGTPAQLEASNDALVHQFMHGQPDGPIPFDAAPRTYDRSSA

SEQ ID NO: 12555 - protein, 456 aa, Xylella fastidiosa 9a5c
MVIHSSVLELIGNTPIVKAQRLDTGLCDLFLKLESANPGGSIKDRVGLSMIEAAECRGHIKPGATLVDGAASSTSMGLAFVARQKGYRLILVVPDNMAWEKISNLKAMGAEVILTRSDVSKGHPEHYQDLAEKLAAETPGAYFINQFGNADNPAAHEFGTGPEILKQMGDHVDAVVLGCDSAGTITGLSRAFDSVASDVELILADPVGSILTQYINEGTCSDKSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYSQRHTVVVDPNDLLTVAYQRMKRYGVSQLPVIEDGQLVGILDESDVLLHVYGDETRFCDPVSTAMVSKLHRLDVKSPIEGLLPVFERGQVAIVMEDAQFLGLITRIDLLNYLRRRMQ

SEQ ID NO: 12556 - protein, 473 aa, Xylella fastidiosa 9a5c
MGDDGDLLMQRAGRAAWDLLRQRWPDARQVLVACGTGNNGGDGYVLACLAHRAGWQVQVVHLPGRGPASLLAQRAYDAYLAAGGQVMLFSGGLETADVLVDALFGIGLNRPLDVPTQGLINALNAAGRPVLALDVPSGVDAERGAVFGTPVYAHVTLQFIVPHVGLYTGPALEAVGERVLAALDVPPALRDALAPCAERWGSQRLASRFRPRRRNSHKGEFGRVLCVGGNWGSGGAIMLSAEAALRSGAGVVHVATREAHVAPLLARCPETMPRGVAGSAELMPLLAAADVVALGPGLGQDPWGQALLAATLDSGCALVIDADALNVLAAAPRPLPPGAILTPHPGEAGRLLGCTTAQVQADRRAAAQALAARFAAVVVLKGAGSLIAAPGCLPCVIDAGNPGMAVAGMGDVLTGVIAALRAQGDSVFDAALFGALLHAAAGDLVARDGGERGLLPSDVLPVLRRLINPDPAL

SEQ ID NO: 12557 - protein, 500 aa, Xylella fastidiosa 9a5c
MDGWVVVAVALMVPQARCMMSFACVGLGGEERRGIARDAGIFWCVARGITDTGGVSDGRLPVLAGVGTAWRCSQAVAVIGGRLVGWTLGVYLLPDEPGQWRFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 12558 - protein, 501 aa, Xylella fastidiosa 9a5c
MLLWLASVKEAFFMSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 12559 - protein, 334 aa, Xylella fastidiosa 9a5c
MSIEQLAETAQAMVASGKGIIAIDESAGTIAKRFSSVGIENIEENRRAYRELLLTTPKLSDYISGAILFDETIRQSTKAGVPFPKYMADHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQLDPLPWPLSFSYGRAMQQAALKLWSQDMKGNFAKAQQVVYERAKENGLAALGKWKG

SEQ ID NO: 12560 - protein, 332 aa, Xylella fastidiosa 9a5c
MCTSSLITSTETFMTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDITITASEPASAALLQGKEWQPHKIQGWTPDFVPEVLNRSVPHHILSVTDDDAITVARRLAAEEGVFSGISGGATVATALQIAQQAQPGAVILAMLPDTGERYFSTPLFADINEHSDDAWLASLG

SEQ ID NO: 12561 - protein, 405 aa, Xylella fastidiosa 9a5c
MSIHDVHEGTCHVTTSAVRAGIDSDTAHGAVTPPIVLSSNFSFERFGHKRKYDYTRSANPTRDLLGEALAELEGGVGGVVTATGIAAIMLVLHALLRPGDRLVVPHDAYGGSWRLFNALAQKGHFELITVDLTDARSVVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEAAVRAFVSGLRYFTLAESLGGVESLIAHPASMTHAAMTPQARAKAGISDGLLRLSVGIEASEDLIVDLVAGLGRAQAVCDGAAREECNV

SEQ ID NO: 12562 - protein, 352 aa, Xylella fastidiosa 9a5c
MNVMGFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSTFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYMGPLSMPVNAGGVVRGRRAISGSFIGGVPETQQMLDFCGQHGIVSDVEIIPIQKINEAYERMLKSDVKYRFVIDMTSLTSSGA

SEQ ID NO: 12563 - protein, 461 aa, Xylella fastidiosa 9a5c
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 12564 - protein, 286 aa, Xylella fastidiosa 9a5c
MVHAYGLVKLMSKTTTHPIAGEHKETNLAIRVRGLINRFGAQTVHDGLDIDVHRGEILGVVGGSGTGKSVLMRTILGLRTPNAGSIEVLGVNPHSQTSEDRRIIARNTGVLFQDGALFSSMTVGENVQVPMKEHHGEFPKRLYYELALLKIKLAGLPANALDKFPSQLSGGMRKRAGLARALALDPPLLFLDEPTAGLDPIGAASFDQLIKTLQKALGLTVFLITHDLDTLYTICNRVAVLAERKVIANAPLAEIETIDHPWIREYFHGPRGRAARTAQHTSTGST

SEQ ID NO: 12565 - protein, 348 aa, Xylella fastidiosa 9a5c
MGIRIQELCKQFEDFTALAGIDLDIRQGELLALLGPSGSGKTTLLRIIAGLEHADAGRVLFGDEDATMMSVQARRVGFVFQHYALFKHMSVYENVAFGLRVRRGKARWPESQISARVFELLSLVQLDGLEQRYPMQLSGGQRQRVALARALAIEPRVLLLDEPFGALDAQVRRDLRRWLREIHDRTGLTTVFVTHDQEEALELADRVAILNQGRIEQVASPAEVYNRPSSPFVYSFVGAVNRLPGCVGADGLEVAGIVLSCPPQLSGWGAVDLYVRPEDLVLDAQEGWLAIVLWSQRSGPRMRVRARLEHSAHEVEIELSSATDEYVEGQKLRLIPRHYGVFFSESGG

SEQ ID NO: 12566 - protein, 268 aa, Xylella fastidiosa 9a5c
MHRIDETFRRLRAQSRKALIPFITAGDPSLEAAVPVMHALVRAGADVIELGVPFSDPMADGPVIQHSSERALQRGVGLAYVLQTVDVFRQSDAVTPVVLMGYLNPLEIYGIARFTQHAVACGVDGVLLVDLPPEEADEIRPIFSAAGLALIVLASPTTSASRLARLSGVAQGYLYYVSFSGVTGADRLDAQSAGDRLRGLRAQTQVPVVVGFGIRDAASAAVMAVDADGVVVGSALVTALSDAPDVDTACRRADAFLAPLRQALDAVK

SEQ ID NO: 12567 - protein, 463 aa, Xylella fastidiosa 9a5c
MTKNAASKARIAYVCTECGTEYSKWQGQCTECSTWNCLSQITLGHAGTVKNPTMKHGNWTGQLDPPKITALKDVQHSEQARISTGIGEFDRVLGGGLVAGAVVLIGGDPGIGKSTLLLQALARMASTLPTLYVTGEESLTQVAGRAVRLDLPLEGLNALAETGIESILQHASSARPRLIVADSVQTLWTETLTAAPGSVSQVRESAAQLVRYAKETGTTVFLVGHVTKEGGIAGPRVLEHMVDAVLYFEGESGSRFRLLRAFKNRFGAVNELGVFAMSEKGLKEVANPSAIFLSGRNSNQPGSCVMVTREGTRPLMIEVQALVDTSPLSNPRRVTVGLEQNRLAMLLAVLHRHGNVLVGDQDVFINIVGGIRVQETAADLPVLLAIRSSLCNRALPEKTIAFGEVGLSGEIRPVPNGEERLREAATHGFKRAIVPKANAPKSAIKDMQIIAVERLDQALEASY

SEQ ID NO: 12568 - protein, 411 aa, Xylella fastidiosa 9a5c
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFHGSFHGRTLAAVTATAQPKYQEGYEPLPGGFRYVDFNHIEALEAAMVGGDVAAVMLEPIQGEGGVMPVVSGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAVEHGVLLLQAGPDVLRFVPALNVSDEELADGLVRLRAALGDYVSRFGG

SEQ ID NO: 12569 - protein, 490 aa, Xylella fastidiosa 9a5c
MTLQLNKNRKTAMSEHYDVVVIGAGPAGYHAAIRAAQLGLKVACVDAALGKDGKPALGGTCLRVGCIPSKALLDSSRQYWNMGHLFNEHGISFKDAKIDVATMIARKDKIVKQFTGGIAMLFKANKITPYYGFAQLQPGNVVKVKQHEGKNIELKGANVILAAGSDSVELPFATFDGETIVDNIGALDFIKVPKRLAVIGAGVIGLELGSVWKRLGAEVTILEAMPDFLAAVDADVAKTAAKEFKQQGLDIKLGAKVSRTEISSKNNKKEVIVTYTDASGKQTFTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKANNIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 12570 - protein, 194 aa, Xylella fastidiosa 9a5c
MNMLNVLRFPVLALALALAFVSSGVLADAGSLLDLDYRPLAGKETVNLQRLYGGKVLLVVNTASKCGFTPQYEGLEALHQKLSPLGFAVLGFPSNDFKGQEPGDEQQIQKFCTLTYGVKFPMFQKVHVKGDEVTPLYQRLTQTTGVAPGWNFHKYLIARDGHVVAQFDSRTRPDDPILLEAIKRELAKPVQVAH

SEQ ID NO: 12571 - protein, 295 aa, Xylella fastidiosa 9a5c
MSKQSVSVVNNEEKTVLSTEKEKVSYAIGLDIARSHVFELIAQDIDVAALQRAIENVFKGGPPLISEEVAQTTDTALRAMLAARSGQQEASGTAPPAVSKENIGLMLGSYMVGPSLLAIKDDIDLPVLLQALRTSFAKRTPLMDEQEMTTRMQAFVASKNAAVAGKNRDEGSAFLSKNKNEKGVITTASGLQYMVLRQGSGSRPTPSNNVRVNYEGKLLSGQVFDSSYQRGQPAEFGLGQVIKGWSEGLSLMPVGSKYRFWIPADLAYGQQGTPGGPIGPDATLTFDVELLSILP

SEQ ID NO: 12572 - protein, 338 aa, Xylella fastidiosa 9a5c
MSVALSIDLSKKKTILCFGEALIDMLAQPPVKKGMPRAFLQCAGGAPANVAVAVARLGGAVQFVGMLGRDMFGDFLFDSFAEAGVVTDGIVRTSAAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTARGQVPTFRVQVQDSNAAGDAFVGGMLYTFAQQFDDAAALIDFCHDPESIASMLRFAAAVGALAVTRHGAFTAMPMLSEVLSLIQEQS

SEQ ID NO: 12573 - protein, 368 aa, Xylella fastidiosa 9a5c
MADTSSMPSIVGLLEPTTFGAIPLNNRVVMAPMTRLRAQADGAPGDLMVEYYRQRAGMGLIVTEGTYPSLESQTGVGQPGIATEEQAGGWRKMTDAVHLAGGHIVLQIMHGGRTAHPGVNGGRRVIAPSAVTLGGEVYTANGKEAFTTPAPMAEADIRDVIAEHVAAAQRAVAAGFDGVEIHGANGYLGQQFLSPASNQRTDQYGGSPENRARFVVELVQAVAEAVGPGRVGLRISPEHNYQETFEPDRSDVLATYGALLDALRPLGLAYLSVLHQEPTGALVEELARRFAGKVAANSGFATFTSLEEAEQIVAAPFIDAVVVGRAALANPDLIERWKSEQPLTEPRYDLFYTHDAAGYTDYPTLAGR

SEQ ID NO: 12574 - protein, 348 aa, Xylella fastidiosa 9a5c
MNASGYAAYSPTEPLRPFSFERRAPRPDDVAIEILYCGVCHTDLHFARGHKGGTFPLVPGHEIVGRVTGVGSEVTRVQVGQVVGVGCMVDSCGHCAACDGGHEQHCLQGMTPTYNGTDRHDGSTTYGGYSDRIVVPEHFVLNVPDQLDLAGVAPLLCAGITTWSPLRRWKVGPGSRVAVVGLGGLGHMALKLAKAMGAEVTLFSRSPGKEADARRLGADHVVISTDAEQMAAIKGKYDLIVDTVPYDHDLNPYVPTLSFHGTLVLVGYMGPLDDKLNTLPVVFGGRAVAGSFIGGIPETQAMLDFCGEHGIVSDVELIRMQEIEDAYERMLRSDVKYRFVIDMASLKA

SEQ ID NO: 12575 - protein, 349 aa, Xylella fastidiosa 9a5c
MTVKAYGAYAADKPLESLDITRRAPGAHDVQIDIAYCGVCHSDLHQVRAEWAGTQFPCVPGHEIVGRVSAVGAHVSGFQPGDLVGIGCIVDSCKHCDDCAEGLENYCDEMVGTYNGPTPDAPGHTLGGYSQQIVVHERYVLRIRHDESQLAAVAPLLCAGITTYSPLRHWNAGPGKKVGVVGIGGLGHMGIKLAHAMGAHVVAFTTSESKRDAAMALGADEVVVSRNPGEMAAHGQSFDFILNTVAAPHDLNAFMTLLKRDGTMTPVGAPASPHPSPEVFNFILKRRSLAGSAIGGIPETQEMLDFCAEHNIVADIELIRAEEINDAYERMLKGDVKYRFVIDNASLAA

SEQ ID NO: 12576 - protein, 504 aa, Xylella fastidiosa 9a5c
MLTRKKSMDCKVGRLGMPIALAVSDCYPNPKRFPLMSLENVEKLVKDKKIEFVDLRFVDMRGVQQHVTFPVNILEPSLFKDGKMFDGSSIAGWKGINESDMVLLPDANTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNGGYRPAVKGGYFPVPPTDSLHDLRAEMVKTLEQVGIETEVHHHEVATAGQCEIGTKFNSLVKKADQLMTMKYILKNVAYRNGKTVTFMPKPMVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFIDGYIALKMQEVTQFRAATHPLEYQMYYAN

SEQ ID NO: 12577 - protein, 190 aa, Xylella fastidiosa 9a5c
MHTHVSHAFASKLSLLSLDRFPMSSIYTFTFTRLDGRPQALADWRGQVLLLVNVASRCGFTPQYAGLEMLWQRYRDAGLIVIGFPCDQFAGQEPGDEAKIAEFCTLNYGVDFPMAAKIKVNGADAHPLWQWLKHRRRGLFGMAAIKWNFTKFLIGRNGQPIARYSPIKSPEQLEVHIVRALGEEGGGNTH

SEQ ID NO: 12578 - protein, 249 aa, Xylella fastidiosa 9a5c
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRASEMVANQGKAK

SEQ ID NO: 12579 - protein, 413 aa, Xylella fastidiosa 9a5c
MPPTKTSFPKQDIRILLLEGVSHSGIETFRAAGYSQIKIHTTSLPEEALQAEIAEAHIIGIRSRTQLNAEVLGHAKRLMAIGCFCIGTNQVDLDTAELSGIPVFNAPYSNTRSVAELIIAEAILLLRGIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 12580 - protein, 206 aa, Xylella fastidiosa 9a5c
MCNEPATSDVALPDLDWAKGDGLLPVIVQDADTLRVLMLGYMNSQALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQVDDALLDESADLLYHLIVLLRARGLSLADAVTVLEARHR

SEQ ID NO: 12581 - protein, 275 aa, Xylella fastidiosa 9a5c
MNQKMFGELISEAVAMFIIIALGESAAAMYILYDPSPYQNAYWGLCICWGLAVTIAIYVTASVSGTHANPAVTLALALYRGFPWKKVLPYWAAQIIGAFIGAMIVYQLYSPVIDYYNHIHQLTRDAGGAAGVFFTSTGMAITPIHALGDEIILTAFLVFGIFAITERFNEAAPTANSGALVIGFLVATIGACMGYLEGWAINPARDLGPRLFAFLAGWGESAFPGKDHYWWIPILGPLIGGVMGATAFQCLIYPFLPARVQAKQQAAILLNRQHP

SEQ ID NO: 12582 - protein, 444 aa, Xylella fastidiosa 9a5c
MNHSRSHTLFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCDMVRMVNSGTEATLSAIRLARGATGRNHIVKFEGCYHGHGDSFLVKGGSGMLTLGMPSSPGVPAELSKLTITLTYNDFDAATALFEEMGHHIAAVIVEPVIGNANCIPPRPGYLQHLRTLCTQYAVLLIFDEVMTGFRVALGGAQALYGVTPDLTTFGKIIGGGMPVGAYGGCRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPDIIEATLEAARAAFQTIANEAAILSESEAPLKMP

SEQ ID NO: 12583 - protein, 374 aa, Xylella fastidiosa 9a5c
MTKPVNTTADKVALSDTALADIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHVEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 12584 - protein, 349 aa, Xylella fastidiosa 9a5c
MFINAYGAHAGDKPLESMQIARRVPGAHDVQIDIHYCGVCHSDIHQVRSEWAGTLFPCVPGHEIVGRVSAIGTHVKGFKTGDLVAVGCMVDSCKDCQECNAGLENYCDGMIGTYNFPTHDAPGHTLGGYSQKIVVDERYVLRIRHPEAQLAAVAPLLCAGITTYSPLRHWNAGPGKKVGIVGIGGLGHMGIKLAHAMGAHVVAFTTSESKRQDAKALGADEVVVSRDEESMAAHVKSFDLILNTVAASHSLDPFLTLLKRDGTLTLVGAPATPHPSPQIFNLIFKRRSIAGSLIGGIAETQEMLDFCAENGIVADIELIRADGINEAYERMMKGDVKYRFVIDNATLAA

SEQ ID NO: 12585 - protein, 425 aa, Xylella fastidiosa 9a5c
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 12586 - protein, 485 aa, Xylella fastidiosa 9a5c
MLRILAEALTYDDVSLVPSHSTVLPKDVNLETRLTRNIRLKLPVLSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLAAAGVDVIIVDTAHGYSQGVLDRVAWIKRYFPQLQVIGGNIVTGDAALALMDAGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 12587 - protein, 469 aa, Xylella fastidiosa 9a5c
MFLPRPDFRIALFICFMAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFSEYGVEGLGIATVMVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAAVLLGWRFRVVSERMFAGIP

SEQ ID NO: 12588 - protein, 494 aa, Xylella fastidiosa 9a5c
MSRKHAFQFLDLPRQMPQRIPVELRTSGDWRELYGKFDKAEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRKVLEGMGVEFRLGVEIGKDLGIEALLEHYDAVFLGVGAYRYTDGGLPGQDLKNVLPALPFLVQNGRIVSGNDPYGRPIAGWEDQVQLPDVTGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLPEWLTAQGIQASSNGRIVVALSDTGDGLTYQTTHPKLFAGGDCVRGADLVVTAVAEGRDAAESIVRWLRATAQVMDVAVI

SEQ ID NO: 12589 - protein, 296 aa, Xylella fastidiosa 9a5c
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 12590 - protein, 483 aa, Escherichia coli
MSQCLYPVIIAGGTGSRLWPLSPVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 12591 - protein, 398 aa, Candida albicans
MFLKNIFIGLAIALLVDATPTTTKRSAGFVALDFSVVKTPKASPVTNGQEGKTSKRQAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLLDSGTTITYLQQDLADQIIKAFNGKLTQDSNGNSFYEVDCNLSGDVVFNFSKNAKISVPASEFAASLQGDDGQPYDKCQLLFDVNDANILGDNFLRSAYIVYDLDDNEISLAQVKYTSASSISALT

SEQ ID NO: 12592 - protein, 325 aa, Aspergillus niger var. macrosporus
SKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESEEAGGYVFSCSTNPPDFTVVIGDYKAVVPGRYINYAPISTGSSTCFGGIQSNSGLGLSILGDVFLKSQYVVFNSEGPKLGFAAQA

SEQ ID NO: 12593 - protein, 459 aa, Pseudomonas sp. KIE171
MSEENKKQILKVRDFIEKHNIDTIRLGAVDIDGVWRGKQVGAEYFLNKAALDGTQISNILFGWDVADHLVDGLEFTGWDSGYPDIALIPDLSTLSLVPWQEKTASVLCDIQHLNGEPLNLSPRNLLRKAIEKAEQLGYKCYAAYEFEFYLLNDSIASISADQWRSINPVEKSGHCYSMLHHSSSSDIMGEVRKYMRDAGIVLEATNSEHGPGQYEINIKYDDALKAADDAIFVKNGIKEIAAKHGMTATFMAKPSAEWSGSSGHVHMSLSDLAGTPVFANPENPGALSEVGYNFLAGMVALAREMSAIYLPNINSYKRTAGASWAGGNSSWGFDNRTVSHRAITSAGSAARVENRIPGADTNPYLVIAASLLSGLYGIENKLKPKDPILGNAYKVSPELARPLAASLEEAAGIFRESEMARVIFPNEFVEHYAQMKVWEIKQSNSFVNNWELARYLDII

SEQ ID NO: 12594 - protein, 507 aa, Pseudomonas sp. KIE171
MSGDYMVQATTNLVGAAYWRGRADEIQFEGRCLIDGKMVEAQSGYTFDCVSPVDGRVLTKVSAGGEADVNRAVAAARSAFRDRRWSGQSPVSRKRTLQAFAALIRLHRDELALLETLDMGKPISASRSVDVEAVASCFEWYAEAIDKLYEQIAPTAETDLALITREPLGVVGAIVPWNFPMLTAAWKTAPALACGNSVVLKPAEQSPLTAIRLAQLALEAGVPEGVFNVVPGLGGSAGRALACHMDVDGIFFTGSTATGRLLTEYAAKSNLKRVCLELGGKSPNIILASYGDIEKAAVASAESMFNNQGEVCIAPSRLIVERSIHKRVVEIVAEVAKRRQPGDPLDPTTRMGALVDANHADRVMGFIGRAKADGATLVAGGTRALTETGGSYVVPTVFDNVSNCMEIARDEVFGPVLSVIPVANVGEAVAVANDSPYGLGAGVWTDRLSDAHKISRELRAGVVYVNCYNDCDITTPFGGVKQSGNGRDKSLYALDEYTELKTTWIKL

SEQ ID NO: 12595 - protein, 252 aa, Lactobacillus delbrueckii subsp. lactis
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGLTSEQVSKLVIAYEPIWAIGTGKTASSDQAEEMCKTIRETVKDLYNEETAENVRIQYGGSVKPANIKELMAKPNIDGGLVGGASLVPDSYLALVNYQD

SEQ ID NO: 12596 - protein, 185 aa, Oryza sativa
MTKLVALSFIVLLSVGLANATRVARYASAGGGGGGGGGGGGSNGGSGWGSGSGSGYGQASGDGSYASGGGGGGGGGGGQNGGSGYGSGSGSGYGQAGGYGPYGGGYAQGGGGGQGGGGGQNGGSGYGSGSGSGYGQAEGYGPYGGGYAQAGGQGGGGGGGQSGPGGSGYGSGSGSGSGSAYGGHP

SEQ ID NO: 12597 - protein, 1033 aa, Rickettsia conorii str. Malish 7
MKLGFNLDFNELDLTGLKKLDQIFLDYLFKADRSLHKDLMLFRSTPLSIIPKDYSEFLLKISPHLDDFLAELFCISKEITISRLKHKDFDIIYECKRKFVQRVAVKKYPPEKIKDIDFEDVYLKLTDLIGANFTSREFAKQIIIWQQAEESFAEELDIAARYAAYRVYLCEGIKPQDNILFNLPQKLDKENLIDDEKILKYQKNERVDFDYTDSFLNLDEALNHSHYCIYCHKQDKDSCSKGLLQPQNRHCEERSDVAISGDLTRLPRSLQSLAMTDLKQGCPLKQKISEMNYVKAQGFNLSALAIIVIDNPMVAATGHRICNDCSKACIYQKQDPVNIPLIESNILEETLKLPYGLEIYLLLTRWNPLNIYAPLPKEPTNYNILVTGLGPAGFSLSYYLLRSGHNVVAIDGLRITLLPFDVHKPIKFWHEYKNLLSERMPRGFGGVAEYGITVRWDKNNLDILRLILERNNNFKYYDGVALDFNITKEQAFDLGFDYIAFCIGAGQPKVLDIENFEAKGVKTASDFLMTLQNGGAFLKNSSTNMVIRMPIAVIGGGLTSLDAATESLYYYKKQVEEFAEDYIEKDLTEEDKEIAEEFIAHAKLFKEAKNNEELRKVFNKLGGATVYYRGRLQDSPVYKLNHEELIYALALGVDFKENMQPLRINVDKYGHVESVEFENRNRRCEQSKTVWQSQEFGLTRLPRQCYAFPRNDIKTKTVIMAIGIENNTQFNEDKYSYFGDCNPKYSGSVVKALASTKEGYDAINKKLINNNPRFKGSYKDFCTQLDYLLTSRVNKINILDDKTFELIIHSPLAAKNFKFGQFFRLQNYSEDAAKLIEPVALSPIDIDVEKGLINFIVFEVGKSTSLCKILSENEKVVLMGPTGSPLEIPQNKKIVIVNFEVGNIGLLKVLKENNNEVIFVTYPDIKVRKLVSVDIVIINASPEIIEELQSLKNEIFSENTKIIVSVNSPMQCMMKGICGQCIQKVKGEQKYIFACSQQNQNAEIVDFKSLKTRLRQNSLQEKMRKLVANLSII

SEQ ID NO: 12598 - protein, 431 aa, Rickettsia conorii str. Malish 7
MTNTRSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWLIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLLKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 12599 - protein, 251 aa, Rickettsia conorii str. Malish 7
MSVEEFKIKIRSLYKSFANHKVLDGIDLDVKKGSSLVILGGSGSGKSVLIKNIVGLIKPDKGKIFIDNVEIQDISSKQKFEIMDGIGFLFQGGALFDSLNIRDNITFETKKLSKKEKNDLAGAKLNAVGLSPRILELYPAELSGGMQKRVALARAICSTPSILFLDEPTTGLDPVMANVINELIIKIQEELEATTITITHDMISAAKIAKEVAMIYQGKIKWYGSKDEMRNSDNPYLKQFINGLTTGPIEV

SEQ ID NO: 12600 - protein, 373 aa, Rickettsia conorii str. Malish 7
MSQNYYQILGVSKTASQADLKKAYLKLAKQYHPDTTDAKDAEKKFKEINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNISFSSAVKCDTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVNLTIPAGTQNGDQLRLRSKGMSKMRSTIRGDMLTHIHVEVPKNLSKRQRELLEEFKKESINEKENDGSFFNKMKSLWS

SEQ ID NO: 12601 - protein, 166 aa, Rickettsia conorii str. Malish 7 [sequence omitted]

SEQ ID NO: 12602 - protein, 161 aa, Rickettsia conorii str. Malish 7
MSNSSKKHLDLPYRPGVGMMILNANNHIFVGKRIDTKISAWQMPQGGIVPGETPSIAAMREMLEEIGSDKGYIIAESKFWYSYDVPSFLIPKLWNGNFRGQKQRWFLIRFTGNNEDININTSNPEFDQWRWASLDELLSIIIPFKRKLYQAVVKEFESLIQ

SEQ ID NO: 12603 - protein, 475 aa, Rickettsia conorii str. Malish 7
MNLLKNITGKNYINGEFIEFGKQISVINPATLKEIATVPNLGLSEINSAINNTVTSFSLWSQSSFEARIAILRRWYNLVIENIEELSYILTLEQGKVLAESKKEILYGASFIDWYTYAIHNIHSTIKPGNSNTHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDIGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 12604 - protein, 459 aa, Rickettsia conorii str. Malish 7
MQEFDLVVIGSGPAGYTGSIRAAQLGMKVACIEKSDTLGGTCLNIGCIPSKVLLNSSEKYEVALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDSKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 12605 - protein, 444 aa, Rickettsia conorii str. Malish 7
MTKKHYICSNCGNISPKWSGQCFDCGVWGSIVEEIISTNQVIVKVGSKQDFDKLSGHVTEQLRIPTPIGEFNRVLGGGLVLGSAILIGGDPGIGKSTLLLQLAASNFASKMNCLYITGEESLDQIKLRAIRLNLTNYNTDILAATNLENIIASIEANKNNIDLIVIDSIQTITTKELSSPPGTVSQIRTCANELVNYAKQNNIIILLSCHVTKDGQLAGPKILEHLVDTVLYFEGDHNNHFRILRSYKNRFGGVGEIGVFEMSGSGLIEVTNPSELFLMQREQNVIGTSIFAGIEGSRPLLMEVQALMVPSNMVTPRRSAVGWDANRLSMILAVLSSRIGLNLANYEVYLSIAGGLKIADPASDLAVTASLISAATGNPVPEHSVFFGEISLSGEIRKTAKAETRIKEAVKLGFNKIICSKFENLTYDFISSVSHLKDLKEIIK

SEQ ID NO: 12606 - protein, 1140 aa, Rickettsia conorii str. Malish 7
MDTNKLYLFKDRRFLPNFIVQLCGCLNDNILKNALVILITYGISGALSKYNNLLVLIANATFVLPFIIFASIAGQIADKYERANLIKIIKICEIGIIAFAIYGFHHNNLLILFCSIGLMGIHSTFFGPIKYSVLPDHLNKDELLGANGFVEAGTFIGIFIGTIIGSYYTISNNFIIYSLITIAFLGFITSLFSPKSKNVNRDIKINFNIIDESINMIKYAKAKKQIYLAILGISWFWFIGAAIISQIPLLAKITFKADENVANLFLAVFSLGVGVGSFLCSKIFEDEITVKYLFISALGISIFGIDLFFASRISSVNYEPTQLKSILVFLSKRHNWRIVIDLLFLAAIGGLYIVPLFAILQHYANPAHRSRIIAVNNLINSIFMVGSTIILSLLFYLNFTIPWIILFISIANIIVTIHIYRLIPEVKIIPFKLLRRIFQICFDLMYKVEVKGFENFQKAGKKVVVVANHISYLDPPLIATYLREEMTFAISPDIQKIWWIKPFLRMARTLPVDPSNPMAIKTLVKEVQKDQKVAIFPEGRISVTGSLMKIYEGPGMIADKAGATVLPVRIDGTQFTHLSKLKNILKRKIFPKITITVLPPVKFANMDATSNQERRSYISRTLYDIMADMMFESSDYQNTVFSSLIEAAKIHGFKKKIVDDFENNAVTYRDLILKSFILGDLIKKNNIFGRNLGLMLPNTTNTLITFYAMQSSGYVPAIINWSSGISTIINSCKLAQIKVVYTSKQFIEKANLHELITNLLDFGIKIIYLEDFKNQIGTALKLKAKIGSYCAQTYYNYFCRNRDDEKPAVIIFTSGTEGEPKAVLLSHRNLQTNRYQITAKVPFSPEDIVFNALPLFHCFGFSGAIITTLNGIKLFLYPSPLNYRSIPEVIYDIGATILISTDTFLNGYANYAHPYDFYSLRYIFAGSEKLKESTRQFWLNKYGIRIFEGYGITEASPIIACNTPMHNKAGTVGRLLPKIDYKLEKVEGINEGGRLFIKGPNIMLGYLDLEGHRTYKEWYDTGDIVKIDSEGYITTLGRLKHFAKIAGEMISLTKIEELASELDPDSLHAAISIPDKTHEDKIILLTTGSNINRENFADAVSKAQIPLLHLPKVIITDSEIPLLTNGKIDYLEIMKNVDRF

SEQ ID NO: 12607 - protein, 212 aa, Rickettsia conorii str. Malish 7
MMVIFLGPPGAGKGTQGKKIAKKIDLPHIAIGDIFRTIIKTSTSEAELINNYVKQGELIPNEIVNQVIKNFLLSSEYKNGYILDGYPRNLEQAKFFESFIKEKIKIIYFDVSDELLIKRILGRYSCKNCGKIYNRYFVQPKTDNVCDVCGSSTFDYRKDDNEEVIKKRIEVYKTETYPLIDYYKNSGNFYIVNGSKNEQEIEIDIQKILKIN

SEQ ID NO: 12608 - protein, 209 aa, Rickettsia conorii str. Malish 7
MKVDSLHNLSYKEEFEGDMKRSTAAYKKVSEDASIGSTYIADISEVGSQISGEPVQRIKIPEHRQILKRSLIKPVIMAGGNGKRLWPLASKDKPKQFKKILSDLTLLQQTLNRNKFLGQPTIITSKKYESITKEQATEIDVEIALITEPLQKNTAVCAIITALSATALGFDIVVLLPSNHHIADDINYLNTINKALHYVNECGICTIFL

SEQ ID NO: 12609 - protein, 175 aa, Rickettsia conorii str. Malish 7
MRHLHYIPINVISAKYGYINTGLSIAENVYLVDHLIEQPILEQANKHFQSNEYFWNSGICVYDVNFFLNLAMNLQPDLFCIAEKAFNTAVKNENSLAIDNEAYNEIAAISIDNTIMEYISGMVMIKADFAWNDLGTWHSLLQVKHRNINYNYCEGNVVTSNTTNSFISSNNKLRS

SEQ ID NO: 12610 - protein, 459 aa, Rickettsia conorii str. Malish 7
MEQYDVAVIGGGPGGYVAAIRAAQLKKKVVLIEKEHLGGVCLNWGCIPTKSLLKSAEVFEYIKHAKDYGIDAKGAEINIKKIVERSREISNKLAGGVKLLLKKNKVTVIDGVASLAGNKVININDKPIVKAGNIIIATGARSRVLKGFKPDGKQIWTSKEAMIPQHVPKSMIIVGSGAIGIEFASFYNSIGVDVTVIEAHNRILPAEDMEISGIARKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEAATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 12611 - protein, 240 aa, Rickettsia conorii str. Malish 7
MIILEKVCKRYGKNYAIKNIDLSFTTKETTVIIGPSGSGKTTLLRILNNLEEPSSGTFLVDGKKLLLKNRRKLLLKVGMVFQNFNLFPHLTVGENLIYTPVNVLNLPKEQAISMAKELLAKFKLTQKFDSYPASLSGGQKQRTAIARALMMKPKILLFDEPTSALDPENIKDVIENINLLKDQMSMVVVTHHLKFAKLIADRVIFMDQGQILANQPAEDFFNKPASHRARLFLENIGDLR

SEQ ID NO: 12612 - protein, 293 aa, Sulfolobus solfataricus P2
MIIVVGSYNVDVILKVNKIPEIGETVIADELYITHGGKGSNQAVSASRLGSHVKIIVAVGDDKHGTDAIEFWKSENIDVSKVKVKSGINTGTAYIFVDKKGRNIIVVNRGANYYLSEDDLNNSLEGDILLMQLEIRESVVKKAAKEFNGIKILNPAPANLKDTEILSLVDIITPNEIEFKELVNTDDFEYGLNLLLKKVKKAVIVTLGERGALLATRDGKKVLIPAPKVNVIDETGAGDVFNAALSVYLEKGYDLETAVEYANKVAALSVTKIGALGPKLDEVVRFLEEIDKA

SEQ ID NO: 12613 - protein, 426 aa, Sulfolobus solfataricus P2
MDKGRCTILNSEELWAQAKQLFAGGVNSPVRAAVKPFPFYVERGKGAYIYTVDGKKFIDYVLGYGPLILGHSPESVKRRIVEQLERGWLFGTPSELEIELARKIRSHIPSAQKIRFVNSGTEATMAAIRLARGYTKRSKILKFSGNYHGAHDYALVEAGSAATEYNVATSDGVPMEIMKTVEICEFNDLDCVDKKLRNEDIATVILEPVMGNAGVILPEKDFLFGLRELTKTYNSLLIFDEVITGFRISIGGAQSYYQIYPDITTLGKIIGGGFPIGAVAGKAEIIDNFTPAGKVFNAGTFNANPISMIAGIATIEELEKEYPYIIANQAAKTLVEELERLLKTKHTINHVGSMFQIFFGIDEVRNYSDAKRADKEYYIKFHERLLKEGVFIPPSQYETIFTSAAHKDDVIADTIDKLMKVIGELN

SEQ ID NO: 12614 - protein, 269 aa, Sulfolobus solfataricus P2
MVDADGIYYLGPEGSFTHEAASLFKGKDLKAESTISLVFKRVYERESSIGIVPIENSLEGPVNETLDNLYNYDNIYVIGEIEKKIELVLAARSDNLSQIKRIYSHPHAFNEAREKLKELGFNEYIPVESTSKAAKIVSQDSEAAAICSNFAAKLYNLKVLITISSHNNYTRFIVLSKEMNSNGNKSMILFTVPHKPGALYKVLQVFYEYNINISMIYSRPLKSIPWQYYFYLEYEGGISNREFIEKLVKSTSVLKIKGSFSKLNNDPGF

SEQ ID NO: 12615 - protein, 297 aa, Sulfolobus solfataricus P2
MSNPLHVFSNEQELLEGMWPTPLLKLRIGNDTWAKLEFYNPFSRSVKDRTAWFLFRQALLKNATHIVEATSGNTGIALASLSSIFGMRFTMFLPVVAPKVYKVFVKLLGGNVIEAGNSTNDVIPLVKKFAEMTNALNLDQFNNPINVIAHYETTAREIDEQLSSIGKKPSRIIATMGTGGHIAGIAKYFKEKYGNDVEIIGVQPSENSRIPGIKRQNGSNSLLRDVKIDRVVDVSLEEAIDGTISVARTSGILIGISAGATVAAYKKISDVSSTTVLIFPDDAFKYVDILEQTLKEI

SEQ ID NO: 12616 - protein, 471 aa, Sulfolobus solfataricus P2
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWSDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 12617 - protein, 454 aa, Sulfolobus solfataricus P2
MSLATLLYKWFKETPSKTFLIDKNQSLTYEQVTREVVYVASNISPGDTVVHIMLNSLQSVINYLAIFWAGGKAVAVDPQTSAEDLKFILEDSNPDLIVTDEEIYKREYDILKSYQVIVNKRGKDVFTKPYEYREDEVGLVYYYAGIVGRTMQVLHSANRVELNSATLYNSIGLKEIRGILTVPLAHVLGNSVLGITLEAGGKLYIMSKFNVDEAIESINKYNINYLSTVPTVYDYLNNEEKRKVDSLELCVSSAAPLYPSTVNTFKSKYGKDIVQQYGFTEGLILTFQPKELSGVISIGKPLPGVEIKIVDDKGNENNEGELWVKAPWLMLGYKDREETARVFNEGWLRTGDLVKIDEKGLLYFRGVKKRMLKFKGYPIFPRDLEEILKTHPMVEDVKVIGEDAGNLGQQPVALVKVKEHKAGIEDELLNYVNSRVAFYKRLKKVYVVDRIERN

SEQ ID NO: 12618 - protein, 257 aa, Sulfolobus solfataricus P2
MEAGKSAEDVFNISRLYLYINDKAILKDITIKIPNNSIFGIMGPSGSGKSTLLKVLNRLIEIYDSKIKVDGKVLYFGKDIFQIDAIKLRKEVGMVFQQPNPFPHLSIYDNIAYPLKSHGIKEKREIKKIVEECLRKVGLWKEVYDRLNSPASQLSGGQQQRLTIARALALKPKVLLMDEPTSMIDIVNSQAIEKLITELKNEIAIVIVSHNPQQVARVADYVAFLYNGELVEWGSSNEIFTSPKNELTEKYVIGRIS

SEQ ID NO: 12619 - protein, 245 aa, Sulfolobus solfataricus P2
MEMGKMLVVYMTLGYPNVQSFKDFIIGAVENGADILELGIPPKYAKYDGPVIRKSYDKVKGLDIWPLIEDIRKDVGVPIIALTYLEDWVDQLENFLNMIKDVKLDGILFPDLLIDYIDDLDKIDGIIKNKGLKNVIFTSPSVPDLLIHKVSKISDLFLYYGVRPTTGVPIPVSVKQLINRVRNLVENKLIVGFGLSSESDLRDALSAGADGIAIGTVFIEEIERNGVKSAINLVKKFRAILDEYK

SEQ ID NO: 12620 - protein, 326 aa, Sulfolobus solfataricus P2
MISMETIQGVNSIGKLDFKVLITDPVDQYMIRTLQNNGLIVDYKPEITREELLKIIDQYQVLIVRSRTKVDKEIIRYGVNLKIIARAGIGLDNIDTEEASKRNIKIVYAPGASTDSAAELTIGLLIAAARKLYDSMNMAKGGIFKKIEGIELAGKTIGIVGFGRIGTKVAKVCKALDMNVIAYDVINIKEKANIVGVRVAESLEELLKNSDVITFHVTVGKDAKPILNKDTFNYIKDNAIIINTSRAVVIDGKALLEYIDKKHLTYATDVLWNEPPKEDWEIKLLRHERVIVTTHIGAQTKEAQHRVAVVTTDNLITALKEIGVLK

SEQ ID NO: 12621 - protein, 419 aa, Sulfolobus solfataricus P2 [sequence omitted]

SEQ ID NO: 12622 - protein, 452 aa, Sulfolobus solfataricus P2
MRKTKIVATLGPSSEEKVKELAEYVDVFRINFAHGDETSHRKYFDLIRTYAPESSIIVDLPGPKLRLGELKEPIEVKKGDKIVFSQKDGIPVDDELFYSAVKENSDILIADGTIRVRVKSKAKDRVEGTVIEGGILLSRKGINIPNVNLKSGITDNDLKLLKRALDLGADYIGLSFVISENDVKKVKEFVGDEAWVIAKIEKSEALKNLTNIVNESDGIMVARGDLGVETGLENLPLIQRRIVRTSRVFGKPVILATQVLTSMINSPIPTRAEIIDISNSIMQGVDSIMLSDETAIGNYPVESVRTLHNIISNVEKSVKHRPIGPLNSESDAIALAAVNASKVSKADVIVVYSRSGNSILRVSRLRPERNIIGVSPDPRLAKKFKLCYGVIPISINKKMQSIDEIIDVSAKLMQEKIKDLKFKKIVIVGGDPKQEAGKTNFVIVKTLEQQKK

SEQ ID NO: 12623 - protein, 509 aa, Sulfolobus solfataricus P2
MKSWKFKALLIGQVILVMLLFSNILAHSQTTTNSSALQQLNQSVQSILNRTSSYPAAAVPSWLDTGSNAWMLTAATFVGLQSVPGVALYYAGLSKKKYAVNSALMIFYAFAAVLVIWIIAGYSFGFGYPALVSIHGYGIFGYPIPAWGGLFEASQTTYGPSGAHANIPTATFIFFQFVFAAITPILLAGGVLERMNFKAWMVFVPFWSLLVYSPVAYWLFAGGWLNQLGAVDFSGGYVIHVDAGVGALAAALAIGPRLASERKLEAHSLPLVLVGAGLIWLGWDGFNGGDPLGATVDAAIAVLNTNIATAVSAVVWMLMDMKFFGKPTLIGATSGAITGLVAITPAAGYVNGWEAALIGIFSGSIPWMALYWLEPKLRVDDTLGVFSTHGIAGIVGGLLTGVFANPAVTQFVAPGLTGALYGNWYQLGIQALAAVIVFVYDFAITFGLLKFIGLFIPLQAPPQELAIGDYAMHGEVAYSELLATIPESAKSKEQSVVLPKKEKEENSEE

SEQ ID NO: 12624 - protein, 225 aa, Sulfolobus solfataricus P2
MSVIRLENVTKIYEGNVKTIALRDINLSIDEGEFISILGPSGSGKSTLLSILGILDRPSQGKVYIYEVDVTKLSDNEISKIRNEYIGFVFQNFNLIQRLSVLQNVELPLVARGIPKKKREEIAINSLKLVGLDGLINKKPSELSGGQQQRVAIARALAQNPKIILADEPTGNLDSSNAKIVMNIFKKINEEFKTTIAVVTHDREVASYTKRKIYIRDGKIVGEER

SEQ ID NO: 12625 - protein, 260 aa, Sulfolobus solfataricus P2
MRFHPPTALRMIRKEVSSPRRDYDLRLRAVSSAGEAVGGDLIEWAMKELSPNVNEFYGCTEANLVTVNNSMWRKIGSVGKPTPGHEIAVIDEKGNEVINQVGEIAVRIEDPVLFLGYYKNPEATAKKFRGHWFLMGDLGLMDQNGYIWFKGRGDDVIKVSGYRLGPEEIESIILQHPAVQEVAVIGKPDRLRGNVIKAFIVLKDGYSPSDSLVEEIQQFVKSRLALYAYPREIEFVKELPRTETGKLKRFELRKREEEKS

SEQ ID NO: 12626 - protein, 267 aa, Sulfolobus solfataricus P2
METIHKYKPTIFFGVPTLYNAMLHVEDWKNYNLTSLRFCVSAGEPLPPLIYIKWKERYGVEILDGIGSTEALHIYISNIPSNSKPGCTGKPVPGYEVKIVDEDGNEVPPKTIGDLYVKGDSVAMFYWNDYESTRKNMMGSWFRTGDKFYRDDEGYYYYVGRSDDMVKTAGLWVSPIEVESALLSHPAVLEAAVVGIPDEVGLVRVVGFVTLKQGYSPSSELAEEIRNYLREKLDHYKVPKEIRFITEIPKTATGKIQRYKFRLGEIK

SEQ ID NO: 12627 - protein, 498 aa, Sulfolobus solfataricus P2
MASYEEVRRSFSWSEVIRYLDENPLDVLTSHDGIAVKRFTKNAMEEISFSDLKRKALRLALYLKEFHNIKKGDVIAILASKKIQQIIVFLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNIYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 12628 - protein, 501 aa, Sulfolobus solfataricus P2
MISVKEMRALEINSSALGVSTLLLMENAGRSVKDEIVKRFNVKDKVAYVYVGHGGKGGDGLVAARHLADEGAKVTVILLGENKHEDAILNLNVIEEMDYSITLVEIKDMDELKPISADILIDAMLGTGFSGKPREPFRSAIKAFNNSKGFKVSIDVPSGINADTGEAYEDEYVKPDLVVTFHDIKPGLLKYNFNTVVTKIGIPVEAEIYVGPGDLIVNARSRPYYSKKGDSGRVLVIGGSYTFSGAPTLAALGALRAGADLVYVASPEDTARIIAGYSPDLITIKLRGKNISPDNFEELKLWIDRADVVVIGPGMGLAEETIEASKLIVNYLKEKNKLAVIDADALKAISGFDLYENAVITPHAGEFKIFFGEEPDKNIRDRISQVITYAKKCKCTVLLKGYVDIISDGKRFKLNKTGNPGMTVGGSGDTLTGITATLMAQKIEPFIAAYLGVFINSLAGTLAYNRLGAHLTPTDIINEIPNVINNPLDSFKRKLYKRVLS

SEQ ID NO: 12629 - protein, 441 aa, Sulfolobus solfataricus P2
MERLIIIGGGAAGMTAASWVRRLKPNMHVTVFESTKMVSHAPCGIPYFTEGLFDDENLFMTYTPEYFIEKRKINVKTNSKVEEVDLRSRIVVVRENQEKRKYEFDYLLFSTGARPKKINAEGDRIFYVHHPAEASYIRQKLWSFNRIAIIGGGILGIEMAEALRARGKKIVLIHRGRYLLNKMLDEDMGKIVTDKVESEIELKLNESLVSVIEEGRVVITDKGKYDVDATVVAIGVEPNIDLVKDQLKIGQTGAIWADNHMRTSVENVYAAGDSTESINIITKKPDWVPFAPVANKMGFVAGNNIGGKDVTFPGVVGTMITKFEEFIIGKTGVTENEAKRYNIKTVSAIVHHKTRARYYPGSKDIIVKLIAEADTMRIIGAQIVGEEEVLGRLNMMAAVIQKGFTAEDLFFVETGYVPPVNRVWDVVTLAARKLFSGISGE

SEQ ID NO: 12630 - protein, 338 aa, Sulfolobus solfataricus P2
MQIRLTLMKALVFDKSGLENLKVKEVQEPQLGPHDVLIRVVKSGLNPIDYFVINAIPVTPMPHIPGAELAGVVEKVGDHVKGLNKGDKVVVYNRVFDGTCDLCLSGREMLCRNGGIMSVITNGGWSEYFSVPDKNIFKIPESMSWDVAASLPVAALTSYHSLKELEVGPNDIIVIFGASGNTGLFAVQLAKKFGATVIAVSRKNWLKEFGADYIVGYDDVVQKVKEITNGKMADVVINSLGSSMWENSLQVLGLDGQLAFFGTLTGSEVKVNLSSLYGRHIKVVGTTGGSRKELMELINLCKDCKVKVHKTYKLDEGVEAVKEIMNENREGRIMLQVS

SEQ ID NO: 12631 - protein, 425 aa, Sulfolobus solfataricus P2
MSKENIFDALKSGKIDYVRVEFVDILGNTKGRSLRRAEFENVINDNKGVDYPESLALMDYKDRPIKSRYEDIIAIPDLNTFVAIPYLERTARVLSFLAQPDGLPYPYCSRSILNKAIEKLKEAGYTLQVSFEPTFYLLNSALNPADYSKAFSLEGLLEQQNFLKLLIKYLEEIDIKVETINKHYGPGQYEVKLSQKPVLEAADSLISSREVIRDTAKMNNVIATFMPKPFKDYPSSSMDITLSLQTVDGKDIMYDPNDSKGIGLSKIAYNFISGILEHLPSILSIAAPTVNSYKRFKEVVTPNMPGIGSERHYIVRLPSYYKDTHQVEFRLADPLANPYILLASMIYAGLDGIERNLMANVNEYYGTLPQTLKESLSRLENDTYMKYNLGQDLISIYINIKNIEIEEYESQITEWERDYYLKAGW

SEQ ID NO: 12632 - protein, 328 aa, Sulfolobus solfataricus P2
MLGAILKNFGEELSLEDVREPSNGIVLKVLATGLCHGDLHVINGDWRYEIKVELPKILGHEIVGEVVKGNGTFKEGDKVLVYNSIGCGKCKYCASKKYQYCEKVKIIGLNINGGFAEYVSVPSDNILLRVDGEPVKLAPLADAGITAYSSAKGITNEDSVLIIGTGAVALLALQILKLKGARVTVIGHNKNKLEKAKELGADEVINIKYDSTIASEVKESKFDYIIDYVGSDYTLSDSMWLLNREGELRIIGEFGGTITVPEQLLVLKGLKVRGILYGSFDDLISVYKLYNEGKIRPIVNTYKLRDINKAIRDLRDGRVIGRAVIVPP

SEQ ID NO: 12633 - protein, 409 aa, Sulfolobus solfataricus P2
MKIAVIGSGPAGVSASLELAKNNKVVLVEKEERLGGTCVLYGCIPSKAMLHPIHLASELEKLGKNITFDLGELRKLGQDASYRLSKGVEYMLEDNGVEVIHGIASLRSGQLIVNNETIQVDYVVLATGTYREVVKGIIYSEDLPYLNKDFKSVIIVGGDVGGVEFGWMLRKLGKEVVLVDKQSSLLPYLDKEVSNAITNYFSKIGVRLYLNRSVKEMKEKEVILENGEKLTADVVYMTFGRKPSIQGFEEINHNPFVIVDEYLRTSLSNVFAAGDIIGTHTAHEAMYAGKIAATNIMGGKKVFNKQGIPKVVYTHPTIAYVGSMEGKCVKINLVELGRAITEKEIDGFLKLCIKDDKIVGAQAFMKDAEEVISLISFLIRYNIKVNEIKDYVAPHPSYIEALTELLNRL

SEQ ID NO: 12634 - protein, 453 aa, Sulfolobus solfataricus P2
MEDLVIIGYGAAGFAALIRANELGIKPVVVGYGEIGGTCVNVGCVPSKRMLRIGELYNYSSKVIGKKLFPEFFQAFQDKAEIVNSLRKEKYEDVINSYDIKLKIGKAYFTSPNAVKVNGEIIEAKKFIIATGSSPNIPNIKGLTEVGFWTNVEALSPDKTISSLAIIGGRALALEFAQMYKRLGVDTTILQRSGRILPDWEPEISLSVKNYLEENDSIPIFTNVRVKEVRKGNGGKIIVTDKGEVEADEILLATGRKPNVDLNLDAAGIELNDKGGIKVNEELRTSNPNVFAAGDVIGGPMLEALAGRQGSIAAENAIMNVHRKIDMLSVPQVVFIEPNVAKVGLTALEAVKEGYDIDQRVVKMDNIAKARILRENYGLIKMVIDKKFRNILGVQMFGKYAAEVINEAALALRFRATIDDLIDTIHVFPTMGESLRIAALAFTGDVSKMSCCV

SEQ ID NO: 12635 - protein, 444 aa, Sulfolobus solfataricus P2
MGEIEDKKIIRDHTFKTWSKQKGWDPIIVSSAKGVYFYDVEGKKYLDFSSQFVNVNLGYGNERVINSIKEQLDRLQYINPSFGADIRVKATKALLKVMPRNISKFFYSTSGTEANEAAIKISRFYKKPRYKILARYRSYHGSTEGSISLTGDYRRWFVEPNTMNGVVRIPEPYCFRCPLKLKYPDCGIACATYVDYVIRQEKNVAAMIIEPITGTNGVIVPPKEYMPLIRKIAKENDVLFIADEVMTGWGRVGEWFAVNLWDIHPDILTTAKGASASYVPIGITGVSKEIGEFFEDEVFAHGHTFEAHPVSLSAIPAVIEEYERLNILSHVKVMGDYLGKRLQELKERHRSIGDVRGVGLFWAIELVKDKNNTPFGGYDDKYEGYTTFVDVLARRLLIEKNTYVYNGPSWFIISPPLIINKEEIDEGVDAIDDILKEADKEFNN

SEQ ID NO: 12636 - protein, 440 aa, Sulfolobus solfataricus P2
MEENLDSSVLEAPIINVTPPGSKSLKLLKDQEEYETSAINYPKYFKIAIDKAQGSTVTDVDGNVYIDLVTGISVVNLGHNNPFVRKRVQEQLEKVWHTLEVPTEIRVNFSKKLLSTLGMRAKLLFTTTGADAVEAAVKIARFITGKKTIIAFEGSYHGITAGTLGLTGANRFKEFQPFFDDRVVKFPYPYPYRCPFKDCLNETLSLLDYAMSNPGYLGGDVAGILVEPIQGEGGYVVPPKGFLKGLKELAEKYSVPLIVDEVQTGVGRTGKMWAYQWENIEPDIVTISKAIGEGIPVSMVAYREDFDKLPTGFHLGTYRGNPLGLAAGLASLEFIESHNILSRVERLGRKALELLKEVQNPHVGDIRGLGFMIGIELVKDSKEPWSEGTKVVIERALKRGLLVYKAGRWDNVIRLMPPLTIPESLLDRAIEILKIILNTL

SEQ ID NO: 12637 - protein, 305 aa, Sulfolobus solfataricus P2
MRQLDALKSPRFTQISTFGRLPICEKNEEIKAAFLGIPFDDAVTYRPGARFGPMGIRQGSRLLRPYNQFLDTYPFDKLNACDMGDINVIPGYIEDTMNAIQTSLYEIISSKNLVPFIAGGDHSITLPILRTLYKKFGKINIVHFDSHYDFWDSYWGKKYTHGTWLRRAIEEGLIKEAVQGGIRASTFSKEDLRDKERLGIRSFTIRDLKYNLDTVIREINSLSGPTHVSIDIDVVDPAFAPGTGTPEVGGLTSFEIIEIVRKLRFDKLVGFDVVEVAPPYDMSEITAMLAANIIYEGMSVLSLNL

SEQ ID NO: 12638 - protein, 466 aa, Sulfolobus solfataricus P2
MELPSVFAPFKRDPTFYPSPKMAMKSPPEDLAYVACLYTGTGINRPDFIAVVDVKPESETYSKVIHKVELSYVNDELHHFGWNACSSALCPNGRPNFERRFLVVPGLRSSRIYIVDTKLNPRQPNIVKTIEPEEVKKVTGYSRLHTVHCGPDGIYISAFGNENGEGPGGILMLDHYSFEPLGKWEIDRSDQYLAYDFWWNLPNEVMVTSEWAVPNTIENGLRLEHLKDRYGNRIHFWDLRRRKKVSSVTLGEENRMALELRPLHDPTKLMGFINMVVSLKDLSSSIWLWYYEDGKWNGEKVIEIPAEPTEGGLPEILKPFKAVPPLVTDIDLSLDDKFLYVSLWGIGEIRQYDVSNPFKPVLTGKVKLGGIFHRADHPSDHKLTGAPQMIEISRDGKRVYVTNSLYSTWDNQFYPEGLKGWMVKLNANPDGGLDVDKEFFVDFGEARSHQVRLRGGDASSDSYCYP

SEQ ID NO: 12639 - protein, 265 aa, Sulfolobus solfataricus P2
MRLCNKDVSQIGFGTWKIGGGYWNPDYSKDSHYIEILKYVISKGINVIDTAEMYGGGHSEELVGKAIENFDRDKIFIITKVWSNHLKYDDLIRSAKNSLKRLNAKYIDLYLIHWPNSSVPLEESLRAMEELVDQGIVNCIGVSNFDIKLLEETMSITKKYEITANEIEYNVENKSAEKDVIPFCERNNIKVIAYSPLARGNAKNNKILEEIGRKYNKTSVQVALNYLLRRSIPIPKASSKDHIDEILGALGWNLSDEDYERISKI

SEQ ID NO: 12640 - protein, 418 aa, Sulfolobus solfataricus P2
MSKKVDELIKEDQEYLMQSFRRWYPFVIDHGFGAIVYDIEGNEYIDFNAGIGVVALGHKNEKIINAVKEQMDKFFHYSLTDFYYEVAIEVAKRLSSLMPFSAKVFYANSGTESVEAAIKIARGHTGRQWIIGFINSFHGRTLGSLAFTSSKAIQRKSFSPLLPSTYLIPYPDRRDPLCKEECTEELLGFIEDWVFKKVVDPNEVAAFIAEPIQGEGGVIVPPKDFFYKLNNLLKKFGILLILDEVQTGIGRTGKMFAFEHFNVTPDLVCLAKALGGGLPLGAVVGRKEIMDLPPGSHANTFGGNPLALAAANVILEEVPKLLDHVSSIGKKIIEELTDTRSPYLYDVRGLGLLIGAELRKNDKPFVEGLEKVLYNSFRRGVLAIGAGESVVRIEPPLIISEELAMKGTKILKEEIEKL

SEQ ID NO: 12641 - protein, 180 aa, Streptococcus pneumoniae TIGR4
MLENDIKKVLVSHDEITEAAKKLGAQLTKDYAGKNPILVGILKGSIPFMAELVKHIDTHIEMDFMMVSSYHGGTASSGVINIKQDVTQDIKGRHVLFVEDIIDTGQTLKNLRDMFKEREAASVKIATLLDKPEGRVVEIEADYTCFTIPNEFVVGYGLDYKENYRNLPYIGVLKEEVYSN

SEQ ID NO: 12642 - protein, 212 aa, Streptococcus pneumoniae TIGR4
MNLLIMGLPGAGKGTQAAKIVEQFHVAHISTGDMFRAAMANQTEMGVLAKSYIDKGELVPDEVTNGIVKERLSQDDIKETGFLLDGYPRTIEQAHALDKTLAELGIELEGVINIEVNPDSLLERLSGRIIHRVTGETFHKVFNPPVDYKEEDYYQREDDKPETVKRRLDVNIAQGEPIIAHYRAKGLVHDIEGNQDINDVFSDIEKVLTNLK

SEQ ID NO: 12643 - protein, 459 aa, Streptococcus pneumoniae TIGR4
MLRFPKDFVWGSSTSGPQTEGRVAGDGKGDNLWDYWFQVEPNRYYNGIGSDKTSTFYENWERDIELLLETGHTAFRTSIQWSRIFPQGCGKVNTQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 12644 - protein, 1280 aa, Streptococcus pneumoniae TIGR4
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 12645 - protein, 490 aa, Streptococcus pneumoniae TIGR4
MINDIILLLFVKIKRRLMMDKLFKLKENGTDVRTEVLAGLTTFFAMSYILFVNPQILSQTGMPAQGVFLATIIGAVAGTLMMAFYANLPYAQAPGMGLNAFFTFTVVFGLGYSWQEALAMVFICGIISLIITLTNVRKMIIESIPNALRSAISAGIGVFLAYVGIKNAGLLKFTIDPGNYTVVGEGADKAQATIAANSSAVPGLVSFNNPAVLVALAGLAITIFFVIKGIKGGIILSILTTTVLAIAVGLVDLSSIDFANNHVGAAFEDLKTIFGAALGSEGLGALVSDTARLPETLMAILAFSLTDIFDTIGTLIGTGEKVGIVATNGENHQSAKLDKALYSDLIGTTVGAIAGTSNVTTYVESAAGIGAGGRTGLTALVVAICFAISSFFSPLLAIVPTAATAPILIIVGIMMLGSLKNIHWDDMSEAVPAFFTSIFMGFSYSITQGIAVGFLTYTLTKLVKGQVKDVHVMIWILDALFILNYISMAL

SEQ ID NO: 12646 - protein, 478 aa, Streptococcus pneumoniae TIGR4
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 12647 - protein, 158 aa, Streptococcus pneumoniae TIGR4
MTSLYDFSVLNQNNQATPLDSYRGKVLLIVNTATGCGLTPQYQGLQELYERYQDQGFEILDFPCNQFMGQAPGSAEEINAFCSLHFQTTFPRFAKIKVNGKEADPLYVWLQDQKSGPLGKRVEWNFAKFLIGRDGQVFERFSSKTDPKQIEEAIQTLL

SEQ ID NO: 12648 - protein, 474 aa, Streptococcus pneumoniae TIGR4
MTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 12649 - protein, 470 aa, Streptococcus pneumoniae TIGR4
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFGMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 12650 - protein, 398 aa, Streptococcus pneumoniae TIGR4
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADNVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 12651 - protein, 448 aa, Streptococcus pneumoniae TIGR4
MPITAADIRREVKEKNVTFIRLMFSDILGTMKNVEIPATDEQLDKVLSNKVMFDGSSIEGFVRINESDMYLYPDLDTWTVFPWGDENGSVAGLICDVYTTEGEPFAGDPRGNLKRALRHMEEVGFKSFNLGPEPEFFLFKLDENGDPTLEVNDKGGYFDLAPTDLADNTRREIVNVLTKMGFEVEASHHEVAVGQHEIDFKYDEVLRACDKIQIFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 12652 - protein, 378 aa, Streptococcus pneumoniae TIGR4
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 12653 - protein, 471 aa, Streptococcus pneumoniae TIGR4
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWVDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKENDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDELNNLTVQDDYRIQYMKEHLLQVAEALQDGVEIMGYTSWGCIDCVSMSTAQLSKRYGLIYVDRNDDGSGTLNRYKKMSFTWYKEVIESNGESLFK

SEQ ID NO: 12654 - protein, 128 aa, Streptococcus pneumoniae TIGR4
MIDVNLINGIALAFEGDAVYSMYIRRHLILKGMTKPNKLHQEATKYVSAKAQARLIALMLEEQVLTEKEEEIYKRGRNTNSHTKAKNADVVTYRMSTGFEAVMGYLHMTENLERLESLVSWCIQKVEG

SEQ ID NO: 12655 - protein, 252 aa, Streptococcus pneumoniae TIGR4
MALVEFKNVEKYYGDYHAFRNINLRFEKGQVVVLLGPSGSGKSTLIRTINGLETVDKGSLLVNGHQVAGASQKDLVPLRKEVGMVFQHFNLYPHKAVLENVTLAPIEVLGIDKKEAEKTAQKYLEFVNMWDKKDSYPAMLSGGQKQRIAIARGLAMHPELLLFDEPTSALDPETIGDVLAVMQKLAHDGMNMIIVTHEMGFAREVADRIIFMADGEVLVDTTDVDNFFDNPSEPRAQQFLSKIINHESDKVK

SEQ ID NO: 12656 - protein, 252 aa, Streptococcus pneumoniae TIGR4
MSETILEIKELKKSFGDNPILQGLSLEIKKGEVVVILGPSGCGKSTLLRCLNGLESIQGGDILLDGQSIVENKKDFHLVRQKIGMVFQSYELFPHLDVLQNLILGPIKAQGRDKKEVTEEALQLLERVGLLDKQHSFARQLSGGQKQRVAIVRALLMHPEIILFDEVTASLDPEMVREVLELINDLAQEGRTMILVTHEMQFAQAITDRIIFLDQGKIAEEGTAQAFFTNPQTKRAQEFLNVFDFSQFGSYL

SEQ ID NO: 12657 - protein, 448 aa, Streptococcus pneumoniae TIGR4
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTCNRQESRFKLITAGSEEKVVGLHGIGYGVDEMIQGFAVAIKMGATKADFDATVAIHPTASEEFVTMR

SEQ ID NO: 12658 - protein, 244 aa, Streptococcus pneumoniae TIGR4
MTETLIKIENLHKSFGKNEVLKGINLEIKRGEVVVIIGPSGSGKSTLLRSMNLLEEATKGKVIFEGVDITDKKNDLFAMREKMGMVFQQFNLFPNMTVMENITLSPIKTKGDSKAVAEKRAQELLEKVGLPDKADAYPQSLSGGQQQRIAIARGLAMEPDVLLFDEPTSALDPEMVGEVLAVMQDLAKSGMTMVIVTHEMGFAREVADRVIFMADGVVVEDGTPEQIFEQTQGQRTKDFLSKVL

SEQ ID NO: 12659 - protein, 501 aa, Streptococcus pneumoniae TIGR4
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 12660 - protein, 286 aa, Streptococcus pneumoniae TIGR4
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGAFMLPKYVEDILEEEEGKK

SEQ ID NO: 12661 - protein, 474 aa, Streptococcus pneumoniae TIGR4
MTRYQNLVNGKWKSSEQEITIYSPINQEELGTVPAMTQTEADEAMQAARAALPAWRALSAVERAAYLHKTAAILERDKEEIGTILAKEVAKGIKAAIGEVVRTADLIRYAAEEGLRITGQAMEGGGFEATSKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 12662 - protein, 434 aa, Streptococcus pneumoniae TIGR4
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 12663 - protein, 453 aa, Streptococcus pneumoniae TIGR4
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPIILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRIPLNMDKIKEGVRLGLPIGGTVFAEVAIFSVVGLIMAKFSPLIIASHQSAMNFSSLMYAFPMSISSAMAIVVSYEVGAKRFDDAKTYIGLGRWTALIFAAFTLTFLYIFRGNVASLYGNDPKFIDLTVRFLTYSLFFQLADTFAAPLQGILRGYKDTVIPFYLGLLGYWGVAIPVRTLFDSLTDFGAYSYWIGLIISLIVSGALYRWRLTVIMKRFESLAKSKC

SEQ ID NO: 12664 - protein, 468 aa, Streptococcus pneumoniae TIGR4
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKEKGYKGEIGVVHALPTKYPLDPENPADVRAAELEDIIHNKFILDATYLGRYSAETMEGVNHILLVNGGSLDLREEDFTALEAAKDLNDFLGINYYMSDWMEAFDGETEIIHNGKGEKGSSKYQIKGVGRRVAPDYVPRTDWDWIIYPQGLYDQIMRVKKDYPNYKKIYITENGLGYKDEFVDNTVYDDGRIDYVKQHLEVLSDAIADGANVKGYFIWSLMDVFSWSNGYEKRYGLFYVDFETQERYPKKSAHWYKKVAETQIID

SEQ ID NO: 12665 - protein, 246 aa, Streptococcus pneumoniae TIGR4
MAKLKIDVNDLHKHYGKNEVLKGITTKFYEGDVVCIIGPSGSGKSTFLRSLNLLEEVTSGHITVNGYDLTEKTTNVDHVRENIGMVFQHFNLFPHMSVLDNITFAPIEHKLMTKEEAEELGMELLEKVGLADKANANPDSLSGGQKQRVAIARGLAMNPDIMLFDEPTSALDPEMVGDVLNVMKELAEQGMTMIIVTHEMGFARQVANRVIFTADGEFLEDGTPDQIFDNPQHPRLKEFLDKVLNV

SEQ ID NO: 12666 - protein, 328 aa, Streptococcus pneumoniae TIGR4
MLNEFPIFDYEDIQLIPNKCVIKSRAEADTSVTLGNHTFKLPVVPANMQTILDENVAEQLAKGGYFYIMHRFDEAGRIPFIKRMHNQGLIASISVGVKDYEYDFVSQLKADTPEYITIDIAHGHADSVISMIQHIKKELPDTFVIAGNVGTPEAVRELENAGADATKVGIGPGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 12667 - protein, 282 aa, Streptococcus pneumoniae TIGR4
MKIAYLGPKGSFSHHVVQTAFPHEELQAFANITDVIKAYEQGLVNYSVVPVENSIEGSVHETLDYLFHQAHIQAVAEIVQPIHQQLMVVPGHTKIEKIFSHPQALAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESCPLKTALGEYFFIIDVDYTDKDLVHFAQKELEAIGIQYKILGAYPIYPISDHGKERR

SEQ ID NO: 12668 - protein, 486 aa, Streptococcus pneumoniae TIGR4
MYPDDSLTLHTDLYQINMMQVYFDQGIHNKKAVFEVYFRQQPFKNGYAVFAGLERIVNYLEDLRFSDSDIAYLESLGYHGAFLDYLRNFKLELTVRSAQEGDLVFANEPIVQVEGPLAQCQLVETALLNIVNYQTLVATKAARIRSVIEDEPLMEFGTRRAQEMDAAIWGTRAAVIGGANGTSNVRAGKLFDIPVLGTHAHALVQVYGNDYEAFKAYAATHKNCVFLVDTYDTLRIGVPAAIQVARELGDQINFMGVRIDSGDIAYISKKVRQQLDEAGFTEAKIYASNDLDENTILNLKMQKAKIDVWGVGTKLITAYDQPALGAVYKIVAIEDETGQMRNTIKLSNNAEKVSTPGKKQVWRITSREKGKSEGDYITYDGVDISDMTEIKMFHPTYTYIKKTVRNFDAVPLLVDIFKEGILVYNLPSLTDIQDYARKEFDKLWDEYKRVLNPQHYPVDLARDVWQDKMDLIDKMRKEALGEGEEE

SEQ ID NO: 12669 - protein, 247 aa, Streptococcus pneumoniae TIGR4
MIKISNLSKSFSGQTVLDHLDLDIQKGEVVALIGSSGAGKSTFLRSLNYLETPDSGSIQIDGFSVDFSKITQEEILALRRKLSMVFQQFNLFERRTALDNVKEGLVVVKKLSDQEATKIAKEELAKVGLSDRENHYPRHLSGGQKQRVALARALAMKPDVLLLDEPTSALDPELVGEVEKSIADAAKSGQTMILVSHDMSFVAQVADKILFLDKGKIIESGTPDEIIHTPKEERTKEFFASYKRTYI

SEQ ID NO: 12670 - protein, 459 aa, Streptococcus pneumoniae TIGR4
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALAGGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 12671 - protein, 364 aa, Streptococcus pneumoniae TIGR4
MSKELHINTILAQAGIKSDEATGALVTPLHFSTTYQHPEFGRSTGFDYTRTKNPTRSKAEEVLAAIESADYALATSSGMSAIVLAFSVFPVGSKVLAVRDLYGGSFRWFNQVEQEGHFHFTYANTEEELIAELEKDVDVLYIETPTNPLMLEFDIEKLAKLAHAKGAKVVVDNTFYSPIYQRPIEDGADIVLHSATKYLAGHNDVLAGVVVTNSLELYEKLFYNLNTTGAVLSPFDSYQLLRGLKTLSLRMERSTANAQEVVAFLKDSPAVKEVLYTGRGGMISFKVADETRIPHILNSLKVFSFAESLGGVESLITYPTTQTHADIPAEVRHSYGLTDDLLRLSIGIEDARDLIADLRQAIEG

SEQ ID NO: 12672 - protein, 255 aa, Streptococcus pneumoniae TIGR4
MSIRVIIAGFKGKMGQAACQMVLTDPDLDLVAVLDPFESESEWQGIPVFKDKADLAGFEADVWVDFTTPAVAYENTRFALENGFAPVVGTTGFTSEEIAELKEFSRAQDLGGLIAPNFALGAVLLMQFATQAAKYFPNVEIIELHHDKKKDAPSGTAIKTAELMAEVRESIQQGAADEEELIAGARGADFDGMRIHSVRLPGLVAHQEVIFGNQGEGLTLRHDSYDRISFMTGVNLGIKEVVKRHELVYGLEHLL

SEQ ID NO: 12673 - protein, 252 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 12674 - protein, 438 aa, Streptococcus pneumoniae TIGR4
MLTYDLIVIGFGKAGKTLAGKLASAGKKVALVERSKAMYGGTCINIGCIPTKTLLVAAEKDLSFEEVIATKNTITGRLNGKNYATVAGTGVDIFDAEAHFLSNKVIEIQAGDEKKELTAETIVINTGAVSNVLPIPGLATSKNIFDSTGIQSLDKLPEKLGILGGGNIGLEFAGLYNKLGSKVTVLDALDTFLPRAEPSIAALAKQYMEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 12675 - protein, 231 aa, Streptococcus pneumoniae TIGR4
MSRIEFSPSLMTMDLDKFKEQITFLNDKVASYHIDIMDGHFVPNITLSPWFIQEVQKISDTPLSVHLMVTDPTFWVDQVLDLQCEYICIHAEVLNGLAFRLIDKIHDAGLKAGVVLNPETPVSTIFPYIDLLDKATIMTVDPGFAGQRFLESTLYKIQELRQLRVQNGYHYIIEMDGSSSRKTFKQIDVAGPDIYVIGRSGLFGLDDDIAKAWDICSRDYEEMTGKTMPIK

SEQ ID NO: 12676 - protein, 230 aa, Streptococcus pneumoniae TIGR4
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 12677 - protein, 222 aa, Streptococcus pneumoniae TIGR4
MKKFVAELIGTFMFVFVGTGAVVFGNGLDGLGHLGIAFAFGLAIVVAAYSIGTVSGAHLNPAVSIAMFVNKRLSSSELVNYILGQVVGAFIASGAVFFLLANSGMSTASLGENALANGVTVFGGFLFEVIATFLFVLVIMTVTSESKGNGAIAGLVIGLSLMAMILVGLKITGLSVNPARSLAPAVLVGGAALQQVWIFILAPIAGGVLAALVAKNFLGTEE

SEQ ID NO: 12678 - protein, 258 aa, Streptococcus pneumoniae TIGR4
MPKTLTEKLNAIKAAGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLANTDIALIPLVSLTTGIERQKELIEGAEGFIYAVAINGVTGKSGNYRADLDKHLAQLHQVADIPVLTGFGVSSQADLERFNAVSDGVIVGSKIVKALHQGEPIQDFIRQAVAYQK

SEQ ID NO: 12679 - protein, 218 aa, Streptococcus pneumoniae TIGR4
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTSVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 12680 - protein, 469 aa, Streptococcus pneumoniae TIGR4
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWLERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 12681 - protein, 449 aa, Streptococcus pneumoniae TIGR4
MSHIKFDYSKVLDKFVAPHEVEYMQSQVTAADELIRKGTGAGSDFLGWLDLPEKYDREEFDRILKAAEQIKSDSDVLVVIGIGGSYLGAKAAIDFLNHHFANLQTKEERKAPQILYAGNSISSTYLADLVEYVADKDFSVNVISKSGTTTEPAIAFRVFKELLVKKYGQEEANKRIYATTDRQKGAVKVEADANGWGTFVVPDDIGGRFSVLTAVGLLSIAASGADIKALMEGANAARKDYTSDKISENEAYQYAAVRNILYRKGYATEILVNYEPSLQYFSEWWKQLAGESEGKDQKGIYPTSANFSTDLHSLGQFIQEGTRIMFETVVRVDKPRKNVLIPTLEEDLDGLGYLQGKDVDFVNKKATDGVLLAHTDGDVPNMYVTLPEQDAFTLGYTIYFFELAIALSGYLNAINPFDQPGVEAYKRNMFALLGKPGFEELSKELNARL

SEQ ID NO: 12682 - protein, 234 aa, Streptococcus pneumoniae TIGR4
MMNELFGEFLGTLILILLGNGVVAGVVLPKTKSNSSGWIVITMGWGIAVAVAVFVSGKLSPAYLNPAVTIGVALKGGLPWASVLPYILAQFAGAMLGQILVWLQFKPHYEAEENAGNILATFSTGPAIKDTVSNLISEILGTFVLVLTIFALGLYDFQAGIGTFAVGTLIVGIGLSLGGTTGYALNPARDLGPRIMHSILPIPNKGDGDWSYAWIPVVGPVIGAALAVLVFSLF

SEQ ID NO: 12683 - protein, 306 aa, Streptococcus pneumoniae TIGR4
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 12684 - protein, 492 aa, Streptococcus pneumoniae TIGR4
MSNWDTKFLKKGFTFDDVLLIPAESHVLPNDADLTTKLADNLTLNIPIITAAMDTVTESQMAIAIARAGGLGVIHKNMSIAQQADEVRKVKRSENGVIIDPFFLTPEHTIAEADELMGRYRISGVPVVETLENRKLVGILTNRDLRFISDYNQPISNHMTSENLVTAPVGTDLATAESILQEHRIEKLPLVDEEGSLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVIAGVGVPQVTAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMIGGIRSGMGYCGAANLKELHDNAQFIEMSGAGLKESHPHDVQITNEAPNYSM

SEQ ID NO: 12685 - protein, 420 aa, Streptococcus pneumoniae R6
MEEVEVAEVKNARVSLTGEKTKPMKLAEVTSINVNRTKTEMEEFNRVLGGGVVPGSLVLIGGDPGIGKSTLLLQVSTQLSQVGTVLYVSGEESAQQIKLRAERLGDIDSEFYLYAETNMQSVRAEVERIQPDFLIIDSIQTIMSPEISGVQGSVSQVREVTAELMQLAKTNNIAIFIVGHVTKEGTLAGPRMLEHMVDTVLYFEGERHHTFRILRAVKNRFGSTNEIGIFEMQSGGLVEVLNPSQVFLEERLDGATGSSIVVTMEGTRPILAEVQALVTPTMFGNAKRTTTGLDFNRASLIMAVLEKRAGLLLQNQDAYLKSAGGVKLDEPAIDLAVAVAIASSYKDKPTNPQECFVGELGLTGEIRRVNRIEQRINEAAKLGFTKIYVPKNSLTGITLPKEIQVIGVTTIQEVLKKVFA

SEQ ID NO: 12686 - protein, 212 aa, Streptococcus pneumoniae R6
MNLLIMGLPGAGKGTQAAKIVEQFHVAHISTGDMFRAAMANQTEMGVLAKSYIDKGELVPDEVTNGIVKERLSQDDIKETGFLLDGYPRTIEQAHALDKTLAELGIELEGIINIEVNPDSLLERLSGRIIHRVTGETFHKVFNPPVDYKEEDYYQREDDKPETVKRRLDVNIAQGEPIIAHYRAKGLVHDIEGNQDINDVFSDIEKVLTNLK

SEQ ID NO: 12687 - protein, 459 aa, Streptococcus pneumoniae R6
MLRFPKDFVWGSSTSGPQTEGRVAGDGKGDNLWDYWFQVEPNRYYNGIGSDKTSTFYENWERDIELLLETGHTVFRTSIQWSRIFPQGCGKVNPQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 12688 - protein, 1256 aa, Streptococcus pneumoniae R6
MRKTPSHTEKKMVYSIRSLKNGTGSVLIGASLVLLAMATPTISSDESTPTTNEPNNRNTTTLAQPLTDTAADSGKNESDISSPRNANASLEKTEEKPATEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWHLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 12689 - protein, 478 aa, Streptococcus pneumoniae R6
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTDQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 12690 - protein, 158 aa, Streptococcus pneumoniae R6
MTSLYDFSVLNQNNQATPLDSYRGKVLLIVNTATGCGLTPQYQGLQELYERYQDQGFEILDFPCNQFMGQAPGSAEEINTFCSLHFQTTFPRFAKIKVNGKEADPLYVWLKDHKSGPLGKRIEWNFAKFLIGRDGQVFERFSSKTDPKQIEEAIQTLL

SEQ ID NO: 12691 - protein, 470 aa, Streptococcus pneumoniae R6
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFVMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 12692 - protein, 398 aa, Streptococcus pneumoniae R6
MAKLTVKDVDLKGKKVLVRVDFNVPLKDGVITNDNRITAALPTIKYIIEQGGRAILFSHLGRVKEESDKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 12693 - protein, 372 aa, Streptococcus pneumoniae R6
MNNTEFYDRLGVSKNASADEIKKAYRKLSKKYHPDINKEPGAEDKYKEVQEAYETLSDDQKRAAYDQYGAAGANGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 12694 - protein, 471 aa, Streptococcus pneumoniae R6
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWIDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKEHDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDEFNNLTVQDDYRIQYMKEHLLQVAEALQDGVEIMGYTSWGCIDCVSMSTAQLSKRYGLIYVDRNDDGNGTFNRYKKMSFTWYKGVIESNGESLFK

SEQ ID NO: 12695 - protein, 252 aa, Streptococcus pneumoniae R6
MSETILEIKELKKSFGDNPILQGLSLEIKKGEVVVILGPSGCGKSTLLRCLNGLESIQGGDILLDGQSIVENKKDFHLVRQKIGMVFQSYELFPHLDVLQNLILGPIKAQGRDKKEVTEEALQLLERVGLLDKQHSFARQLSGGQKQRVAIVRALLMHPEIILFDEVTASLDPEMVREVLELINDLAQEGRTMILVTHEMQFAQAIADQIIFLDQGKIAEEGTAQAFFTNPQTKRAQEFLNVFDFSQFGSYL

SEQ ID NO: 12696 - protein, 448 aa, Streptococcus pneumoniae R6
MREYDIIAIGGGSGGIATMNRAGEHGAQAAVIEEKKLGGTCVNVGCVPKKIMWYGAQIAETFHQFGEDYGFKTTDLNFDFATLRRNRESYIDRARSSYDGSFKRNGVDLIEGHAEFVDSHTVSVNGELIRAKHIVIATGAHPSIPNIPGAELGGSSDDVFAWEELPESVAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTSSEEFVTMR

SEQ ID NO: 12697 - protein, 244 aa, Streptococcus pneumoniae R6
MTETLIKIENLHKSFGKNEVLKGINLEIKRGEVVVIIGPSGSGKSTLLRSMNLLEEATKGKVIFEGVDITDKKNDLFAMREKMGMVFQQFNLFPNMTVMENITLSPIKTKGESREVAEKRAQELLEKVGLPDKADAYPQSLSGGQQQRIAIARGLAMEPDVLLFDEPTSALDPEMVGEVLAVMQDLAKSGMTMVIVTHEMGFAREVADRVIFMADGVVVEDGTPEQIFEQTQEQRTKDFLRKVL

SEQ ID NO: 12698 - protein, 290 aa, Streptococcus pneumoniae R6
MKVINQTLLEKVIIERSRSSHKGDYGRLLLLGGTYPYGGAIIMAALAAVKNGAGLVTVGTDRENIPALHSHLPEAMAFALQDKQLLKEQLEKAEVVLLGPGLGDNAFGEDLVKQVFAGLKQNQILIVDGGALTILARTSLSFPSSQLILTPHQKEWEKLSGITIEKQKEDTTASALTSFPKGTILVEKGPATRVWQAGQSDYYQLQVGGPYQATGGMGDTLAGMIAGFVGQFRQASLYERVAVATHLHSAIAQELSQENYVVLPTEISRYLPKIMKIICQQERVSKDKLV

SEQ ID NO: 12699 - protein, 467 aa, Streptococcus pneumoniae R6
MESKMNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIALPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKVPKNATILTGLASAVAAGMFPLASIAAFLNICTLAYLILLAYGLIRLRKEKGMPKAGEFKTPLVPLLPILSIIICLSFMLQYNVNTWIAFLVALLVGSIIYFTYGYKHSTIEE

SEQ ID NO: 12700 - protein, 436 aa, Streptococcus pneumoniae R6
MELSEMINNVFESCIHPEYHFIDLSKIKENRIAIIGGNKSEYLNLILNLMLQGKVVIPINPIQTNSQIETLLNLSDVEAVLTDNSFQCKSEKKTYLFCEFKHIYNNHEREISDTPLVFFSSGTTGVPKPVMINKLAFTELINLMIAQLEISSDDVLYLPSHIAFIQSLWAAMIVIFSGGRVIFKDRITYKTFFKELQLNDATITVMVPTTMNKLVNLYTNTLQECKKLRCIIVGGEIINKDSANFLLNKLKNTNIANAYGMVETTAVCCLQYGRDLKNINSVGTTLPGVEVEVKNIDNDGNGDIWIKTNRFMSGYYPSKYTGEWLYTGDRGYKNKEGLLFVTGRESLSINKGGIKINPIEIEQIILQLPDIQLCKVEKISDNIYGENYILEVISEIKDKNRITGQILKSLGKYYLPDSIKFVESIETTSSGKLKRN

SEQ ID NO: 12701 - protein, 474 aa, Streptococcus pneumoniae R6
MTRYQNLVNGKWKSSEQEITIYSPINQEELGTVPAMTQTEADEAMQAARAALPAWRALSAIERAAYLHKTAAILERDKEKIGTILAKEVAKGIKAAIGEVVRTADLIRYAAEEGLRITGQAMEGGGFEAASKNKLAVVRREPVGIVLAIAPFNYPVNLSASKIAPALIAGNVVMLKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 12702 - protein, 434 aa, Streptococcus pneumoniae R6
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 12703 - protein, 453 aa, Streptococcus pneumoniae R6
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPTILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRILLNMDKIKEGVRLGLPIGGTVFAEVAVFSVVGLIMAKFSSLIIASHQSAMNFSSLMYAFPMSISSAMAIVVSYEVGAKRFDDAKTYIGLGRWTALIFAAFTLTFLYIFRGNVASLYGNDPKFIDLTARFLTYSLFFQLADTFAAPLQGILRGYKDTVIPFYLGLLGYWGVAIPVATLFDSLTDFGAYSYWIGLIISLIVSGALYRWRLTVIMKRFESLAKSKR

SEQ ID NO: 12704 - protein, 468 aa, Streptococcus pneumoniae R6
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKDKGYKGEIGVVHALPTKYPLDHENPADVRAAELEDIIHNKFILDATYLGRYSAETMEGVNHILSVNGGSLDLREEDFTALEAAKDLNDFLGINYYMSDWMEAFDGETEIIHNGKGKKGSSKYQIKGVGRRVAPDYVPRTDWDWIIYPQGLYDQIMRVKKDYPNYKKIYITENGLGYKDEFVDNTVYDDGRIDYVKQHLEILSDAIADGANVKGYFIWSLMDVFSWSNGYEKRYGLFYVDFETQERYPKKSAHWYKKVAETQIID

SEQ ID NO: 12705 - protein, 371 aa, Streptococcus pneumoniae R6
MRKPGNIYTRITNPTTAALEGGVEALATASGMTAVTYTILALAHAGEHVVAASTIYGGTFNLLKEPLPRYGITTTFVDVDNLEEVEAAIKDNTKLVLIETLGNPLINIPDLEKLAEIAHKHQIPLVSDNTFATPYLINVFSHGVDIAIHSATKFIGGHGTTIGGIIVDSGRFDWTASGKFPQFVDESPSCHNLSYTHDVGAAAFIIAVRVQLLRDTGAALSPFNAFLLLQRLETLSLRVERHVQNAETIVDFLVNHPKVEKVNYPKLADSPYYALAEKYLPKGVGSIFTFHVKGDEEEARKVIDNLEIFSDLANAADAKSLVVHPATITHGQLSEKDLEAAGVTPNQIHLSIGLENVEDLIEDLRLALEKI

SEQ ID NO: 12706 - protein, 246 aa, Streptococcus pneumoniae R6
MAKLKIDVNDLHKHYGKNEVLKGITTKFYEGDVVCIIGPSGSGKSTFLRSLNLLEEVTSGHITVNGYDLTEKTTNVDHVRENIGMVFQHFNLFPHMSVLDNITFAPIEHKLMTKEEAEKLGMELLEKVGLADKANANPDSLSGGQKQRVAIARGLAMNPDIMLFDEPTSALDPEMVGDVLNVMKELAEQGMTMIIVTHEMGFARQVANRVIFTADGEFLEDGTPDQIFDNPQHPRLKEFLDKVLNV

SEQ ID NO: 12707 - protein, 328 aa, Streptococcus pneumoniae R6
MLNEFPIFDYEDIQLIPNKCVIKSRAEADTSVTLGNHTFKLPVVPANMQTILDENVAEQLAKGGYFYIMHRFDEAGRIPFIKRMHDQGLIASISVGVKDYEYDFVSQLKADAPEYITIDIAHGHADSVISMIQHIKKELPDTFVIAGNVGTPEAVRELENAGADATKVGIGPGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 12708 - protein, 282 aa, Streptococcus pneumoniae R6
MKIAYLGPKGSFSHHVVQTAFPHEELQAFANITDVIKAYEQGLVNYSVVPVENSIEGSVHETLDYLFHQAHIQAVAEIVQPIHQQLMVVPGHTKIEKIFSHPQALAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESRPLKTALGEYFFIIDVDYTDKDLVHFAQKELEAIGIQYKILGAYPIYPISDHGKERR

SEQ ID NO: 12709 - protein, 459 aa, Streptococcus pneumoniae R6
MSKIVVVGANHAGTACINTMLDNFGNENEIVVFDQNSNISFLGCGMALWIGEQIDGAEGLFYSDKEKLEAKGAKVYMNSPVLSIDYDAKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 12710 - protein, 364 aa, Streptococcus pneumoniae R6
MSKELHINTILAQAGIKSDEATGALVTPLHFSTTYQHPEFGRSTGFDYTRTKNPTRSKAEEVLAAIESADYALATSSGMSAIVLAFSVFPVGSKVLAVRDLYGGSFRWFNQVEQEGRFHFTYANTEEELIAELEKDVDVLYIETPTNPLMLEFDIEKLAKLAHAKGAKVVVDNTFYSPIYQRPIEDGADIVLHSATKYLAGHNDVLAGVVVTNSLELYEKLFYNLNTTGAVLSPFDSYQLLRGLKTLSLRMERSTANAQEVVAFLKDSPAVKEVLYTGRGGMISFKVADETRIPHILNSLKVFSFAESLGGVESLITYPTTQTHADIPAEVRHSYGLTDDLLRLSIGIEDARDLIADLRQALEG

SEQ ID NO: 12711 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 12712 - protein, 438 aa, Streptococcus pneumoniae R6
MLTYDLIVIGFGKAGKTLAGKLASAGKKVALVERSKAMYGGTCINIGCIPTKTLLVAAEKDLSFEEVIATKNTITGRLNGKNYTTVAGTGVDIFDAEAHFLSNKVIEIQAGDEKQELTAETIVINTGAVSNVLPIPGLATSKNVFDSTGIQSLDKLPEKLGVLGGGNIGLEFAGLYNKLGSKVTVLDTLDTFLPRAEPSIAALAKQYLEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 12713 - protein, 222 aa, Streptococcus pneumoniae R6
MKKFVAELIGTFMLVFVGTGAVVFGNGLDGLGHLGIAFAFGLAIVVAAYSIGTVSGAHLNPAVSIAMFVNKRLSSSELVNYILGQVVGAFIASGAVFFLLANSGMSTASLGENALANGVTVFGGFLFEVIATFLFVLVIMTVTSESKGNGAIAGLVIGLSLMAMILVGLKITGLSVNPARSLAPAVLVGGAALQQVWIFILAPIAGGVLAALVAKNFLGTEE

SEQ ID NO: 12714 - protein, 258 aa, Streptococcus pneumoniae R6
MPKTLTEKLNAIKATGKGIFVPYIMAGDHEKGLDGLGETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFVYAVAINGVTGKSGNYRADLDKHLAQLHQVADIPVLTGFGVSSQADLERFNAVSDGVIVGSKIVKALHQGEPIQDFIRQAVAYQK

SEQ ID NO: 12715 - protein, 218 aa, Streptococcus pneumoniae R6
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTPVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 12716 - protein, 483 aa, Streptococcus pneumoniae R6
MLYFMYRIIERRLSMKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWPERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 12717 - protein, 426 aa, Streptococcus pneumoniae R6
MFKKNKDILNIALPAMGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMNLKG

SEQ ID NO: 12718 - protein, 449 aa, Streptococcus pneumoniae R6
MSHIKFDYSKVLDKFVAPHEVEYMQSQVTAADELIRKGTGAGSDFLGWLDLPEKYDREEFDRILKAAEQIKSDSDVLVVIGIGGSYLGAKAAIDFLNHHFANLQTKEERKAPQILYAGNSISSTYLADLVEYVADKDFSVNVISKSGTTTEPAIAFRVFKELLVKKYGQEEANKRIYATTDRQKGAVKVEADANGWGTFVVPDDIGGRFSVLTAVGLLPIAASGADIKALMEGANAARKDYTSDKISENEAYQYAAVRNILYRKGYATEILVNYEPSLQYFSEWWKQLAGESEGKDQKGIYPTSANFSTDLHSLGQFIQEGTRIMFETVVRVDKPRKNVLIPTLEEDLDGLGYLQGKDVDFVNKKATDGVLLAHTDGDVPNMYVTLPEQDAFTLGYTIYFFELAIALSGYLNAINPFDQPGVEAYKRNMFALLGKPGFEELSKELNARL

SEQ ID NO: 12719 - protein, 234 aa, Streptococcus pneumoniae R6
MMNELFGEFLGTLILILLGNGVVAGVVLPKTKSNSSGWIVITMGWGIAVAVAVFVSGKLSPAHLNPAVTIGVALKGGLPWASVLPYILAQFAGAMLGQILVWLQFKPHYEAEENAGNILATFSTGPAIKDTVSNLISEILGTFVLVLTIFALGLYDFQAGIGTFAVGTLIVGIGLSLGGTTGYALNPARDLGPRIMHSILPIPNKGDGDWSYAWIPVVGPVIGAALAVLVFSLF

SEQ ID NO: 12720 - protein, 306 aa, Streptococcus pneumoniae R6
MSIYNNITELIGQTPIVKLNNIVPEGAADVYIKLEAFNPGSSVKDRIALSMIEKAEQDGILKLGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 12721 - protein, 423 aa, Lupinus albus
MARKKIREYDSKRLLKEHYKRLSGNDLPIKSAQVTETTDFTELQEKEPWLSSSKLVVKPDMLFGKRGKSGLVALNLDLAQVASFVKERLGNEVEMSGCKGPITTFIVEPFIPHNEEFYLNIVSDRLGNSISFSECGGIEIEENWDKVKTVFVPTGVSLTSEIIAPLVATLPLEIKGEIEEFLKVIFNLFQDLDFTFLEMNPFTLVDGKPYPLDMRGELDDTAAFKNFKKWGNIEFPLPFGRVMSPTESFIHGLDEKTSASLKFTVLNPKGRIWTMVAGGGASVIYADTVGDLGFANELGNYAEYSGAPKEDEVLQYARVVIDCATANPDGQKRALVVGGGIANFTDVAATFSGIIRALKEKESKLKAARMHIYVRRGGPNYQKGLAKMRELGEEIGIPIEVYGPEATMTGICKEAIQCITASA

SEQ ID NO: 12722 - protein, 326 aa, Staphylococcus aureus subsp. aureus N315
MIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEGHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 12723 - protein, 403 aa, Staphylococcus aureus subsp. aureus N315
MTFEKETVLKTLFPEDVLSIAKGLTDGEVEFLQQVDSLLESNYRENINQHWIDATVPEDYFKDLGELNYFNNPLLYKDRPNAKMPSQLFQFFMSYLLARFDISLATLLGVHQGLGHNTFYFGGSKEQIAKYVPKLLSHELRTCFALTEPEHGSDVAGGLETVAERQGDTWVINGEKKWIGGAHVSDVIPVFAVNKKTGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 12724 - protein, 346 aa, Staphylococcus aureus subsp. aureus N315
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNWRALFINVSFINCITYSSLVKLHFP

SEQ ID NO: 12725 - protein, 422 aa, Yersinia pestis CO92
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGERRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVVDRGS

SEQ ID NO: 12726 - protein, 377 aa, Yersinia pestis CO92
MIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 12727 - protein, 336 aa, Yersinia pestis CO92
MTLLTHLPANMVAIEITQFGGPEVLVPAKRPTPMPAAGEILVKVSAAGVNRPDVMQRRGQYAPPPGASDIPGLEVAGEVVATAADVTRFKIGDNVCGLIAGGGYAQYCVIHETNALPIPQGLSAIEAAALPETFFTVWTNLFQRGHFTAGETVLIHGGSSGIGTTAILLSKAFGAATVIVTVGSEEKRQACLNLGADIAINYHTQDFVAETKRATAGKGADVIVDLIAGDYVARNYDAAAMNGRIVQIGTQNGHAKDLNLMLMLIKRLTHTGSTLRSRTVAEKALIANELEQHVWPLLSEGKMKPQIFSTFPLEAAAKAHELMESSTHIGKIVLTA

SEQ ID NO: 12728 - protein, 1323 aa, Yersinia pestis CO92
MANTTMGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 12729 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 12730 - protein, 404 aa, Yersinia pestis CO92
MSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 12731 - protein, 375 aa, Yersinia pestis CO92
MKILVDENMPYAEELFRRLGDVQAVPGRPIPRDALVDADALMVRSVTKVNEALLHGTSIGFVGTATAGTDHVDDTWLRQQGIGFSAAPGCNAIAVVEYVFSALMMMAERDGFQLRDKTVGIIGVGNVGSRLNARLQALGVRTLLCDPPRADRGDNEAFWPLEKLVREADVLTFHTPLNKTGAYQSLHMADDELLAALPDGRILINACRGAVVDNAALLRALEKGKKLSVVLDVWEPEPDLSLPLLARVDIGTPHIAGYTLEGKARGTTQVFEAFSQHLGQPQSVELASLLPVPEFSHLRLNGELDEGKLKRLMHLVYDVRRDDAPLRHVAGLPGEFDRLRKHYQERREWSSLCVQCDDATSAGLLQQLGFTTQLL

SEQ ID NO: 12732 - protein, 429 aa, Yersinia pestis CO92
MSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 12733 - protein, 361 aa, Yersinia pestis CO92
MRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 12734 - protein, 487 aa, Yersinia pestis CO92
MLRIAKEALTFDDVLLVPAHSTVLPNTAELGTQLTATIRLNIPMLSAAMDTVTESRLAIALAQEGGLGFIHKNMSIERQAEEVSRVKKHESGVVTEPQTVTPTTTLRQVKELTARNGFAGYPVVTEDYELVGIITGRDVRFVTDLDQPVTAVMTPKERLVTVKEGETREVVLQKMHEKRVEKVLVVDDSFHLRGMITVKDFQKAERKPNACKDEHGRLRVGAAVGAGAGNEERIDALVAAGVDVLLIDSSHGHSEGVLQRIRETRAKYPNLQIVGGNVATGAGAKALADAGVSAVKVGIGPGSICTTRIVTGVGVPQITAIADAVEALEGTGIPVIADGGIRFSGDIAKAIAAGASCVMVGSMLAGTEESPGEIELYQGRSFKSYRGMGSLGAMSKGSSDRYFQTDNAADKLVPEGIEGRVAYKGLLKEIVHQQMGGLRSCMGLTGCGTINELRTKAEFVRISGAGIQESHVHDVTITKESPNYRMM

SEQ ID NO: 12735 - protein, 356 aa, Yersinia pestis CO92
MIELSVDNLHLTYGDNPVLKGVSMELKRGEVVSLLGPSGSGKTTLLRAVAGLEKPSQGHIIIGEKTVYDGSSHSEIPAEERNLGLVFQSYALWPHKTVSENVAYPLKLRKISTSEISQRVQAVLEQLGLGALGNRHPHQLSGGQQQRVAIGRALVYNPPVILLDEPLSNLDAKLREEARVFLRELIMNLGLSALMVTHDQNEAMAISDRILLLNNGKIEQQGTPQEMYGSPSTLFTAEFMGSNNRLHGKIIDVRDGKARIEGKDWGLWGWAGEGVTAGQEGTAVIRVERVRLGDNLDGNQLELPLLTSMYLGDRWEYLFRTVADDFVIRAYGPEVRGKESCHLSLPTEHLWIFPKL

SEQ ID NO: 12736 - protein, 463 aa, Yersinia pestis CO92
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 12737 - protein, 178 aa, Yersinia pestis CO92
MRHTVEVMISEQEVKTRIAELGRQISEHYRDSGSDMVLVGLLRGSFMFMADLCRAIDVSHEVDFMTASSYGNGMSTTRDVKILKDLDEDIRGKDVLIVEDIIDSGNTLSKVREILQLRGPKSLAICTLLDKPERREVHVPVEWVGFTIPDEFVVGYGIDYAQRYRHLPYVGKVVTLDE

SEQ ID NO: 12738 - protein, 296 aa, Yersinia pestis CO92
MSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 12739 - protein, 465 aa, Yersinia pestis CO92
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 12740 - protein, 450 aa, Yersinia pestis CO92
MTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 12741 - protein, 443 aa, Yersinia pestis CO92
MWFFLKSRDNVPLVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 12742 - protein, 467 aa, Yersinia pestis CO92
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 12743 - protein, 314 aa, Yersinia pestis CO92
MELKDIGNTELIELKNLSINNNSLFSKCEFNNPTGSHKDRTFLHILNILEEENKIIPGMTLIDCSTGNGGAALAWIGQKKGYKIKIFMPEGMTEERKEQIYSFGGEIIETPKENFLKGAVKAATEYSNHQKNIFFLNQSDTTLNKDAWHSCGEEIVRKMKEINKKPDYFICSIGTGGTFSGIAEILKKAYPRIHTVGIEVDQSAPIYSQRHGLNFHHKHHNLMGLGAGVISVNTLLDLIDEVRVVNGKAAWERMKSFIEKERLGIGPTCGANLLITEDIMQEVNGKVIVTLFFDSAWKYKSCWDGVYPGYKETQ

SEQ ID NO: 12744 - protein, 442 aa, Yersinia pestis CO92
MSKSNLDTEQGLLERVFKLKQHGTTARTELIAGITTFLTMVYIVFVNPQILGVAGMDVQAVFVTTCLIAAFGSIFMGLLANLPVALAPAMGLNAFFAFVVVGAMGISWQVGMGAIFWGAIGFLLLTIFRIRYWMIANIPLSLRVGITSGIGLFIAMMGLKNAGIVVANPDTLVAVGNLTSHSVLLGALGFFIIAVLASRNIHAAVLVSIVVTTLIGWALGDVHYSGVFSMPPSVTSVVGQVDLAGALNIGMAGIIFSFMLVNLFDSSGTLIGVTDKAGLADHKGKFPRMKQALYVDSISSVAGAFIGTSSVTAYIESSSGVSVGGRTGLTAVVVGILFLLVIFISPLAGMVPAYAAAGALIYVGVLMTSSLARVKWDDLTEAVPAFVTAVMMPFSFSITEGIALGFISYCLMKLGTGRWREISPCVVVVALLFMLKIAFVDH

SEQ ID NO: 12745 - protein, 401 aa, Mycobacterium vaccae
MAKVLCVLYDDPVDGYPKTYARDDLPKIDHYPGGQILPTPKAIDFTPGQLLGSVSGELGLREYLESNGHTLVVTSDKDGPDSVFERELVDADVVISQPFWPAYLTPERIAKAKNLKLALTAGIGSDHVDLQSAIDRNVTVAEVTYCNSISVAEHVVMMILSLVRNYLPSHEWARKGGWNIADCVSHAYDLEAMHVGTVAAGRIGLAVLRRLAPFDVHLHYTDRHRLPESVEKELNLTWHATREDMYPVCDVVTLNCPLHPETEHMINDETLKLFKRGAYIVNTARGKLCDRDAVARALESGRLAGYAGDVWFPQPAPKDHPWRTMPYNGMTPHISGTTLTAQARYAAGTREILECFFEGRPIRDEYLIVQGGALAGTGAHSYSKGNATGGSEEAAKFKKAV

SEQ ID NO: 12746 - protein, 203 aa, Ananas comosus
ACENWGFFEILNHGITREMMDEVERLTKDHYRRSREQRFEEFANKALEDGTNGVDVSSNLDWESTFFVRHLPVSNISELSDLNDHYRNVMKEFAVELEKLAERLLDLLCENLGLEKGYLKKAFCGSNGPTFGTKVSSYPPCPRPDLIKGLRAHTDAGGIILLFQDDRVSGLQLLKDGEWVDVPPTPYSIVVNLGDQLEVITNG

SEQ ID NO: 12747 - protein, 131 aa, Saccharomyces cerevisiae
SGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 12748 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVNLWVLGWAAFPDNLARDGLRYDSASDNVFMDAEQEAKAKKANNPQHSLTKDEIKQYIKEYVQAAKNSIAAGADGVEIHSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKK

SEQ ID NO: 12749 - protein, 298 aa, Schizosaccharomyces pombe
MSGQNNVVGVHYKVGRRIGEGSFGVIFEGTNLLNNQQVAIKFEPRRSDAPQLRDEYRTYKLLAGCTGIPNVYYFGQEGLHNVLVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLL

SEQ ID NO: 12750 - protein, 339 aa, Aspergillus aculeatus
ATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 12751 - protein, 507 aa, Triticum aestivum
MEVESSAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLHLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPITLVHFPQWGSMFFPASADATEEEYYASEWSEEEKGKGLHIAGQKFAENSRSERGRRNVILATSATPPNNTPQHV

SEQ ID NO: 12752 - protein, 361 aa, Kluyveromyces wickerhamii
MLFNKNLIILSSAILTSASPLEKRDSCTLTGSTTGGSGVNGCSAVIVKDVSVPAGKTLDLTGLKSGATVTFEGTTSFGYQEWEGPLISIAGSGITVTGASGNLIDGDGARWWDGKGDNGKTKPKLLKLKLTGDSVVSGLKIKNSPRQVVSVNQCSDLTIHDITIDNTDGDGSGKGHNTDGFDVGSSDTVTIKNCKVYNQDDCIAVNSGKNIYFQNNYCSGGHGISIGSVGDRSDNVVDSVWFENNQVVDSDNGLRIKTVQDATGKVNNVHFLDNEISNIAKYGIVVESDYKDGSTTGTPGSGVPITNLEINGVTGSVASSAKRVKILVAGASSWKWSNIKFTGGQSYSSCEGIPSGSGASC

SEQ ID NO: 12753 - protein, 475 aa, Abies magnifica
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQRNHGMHFRVLAKALRMSGGDHIHAGTVVGKLEGERDVTLGFVDLLRDDFIEKDRSRGIFFTQDWVSMPGVLPVASGGIHVWHMPALTEIFGDDSVLQFGGGTLGHPWGNAPGAAANRVALEACVQARNEGRDLAREGNEVIREATKWSPELAAACEVWKEIKFEFDTIDYL

SEQ ID NO: 12754 - protein, 264 aa, Burkholderia cenocepacia
MGITVRNLQKRFGDFTALDNVSLDFPPGELVALLGPSGCGKTTLLRVIAGLEHADAGQVVLQGLDVASVGARDRQVGFVFQHYALFRHMTVFENVAFGLRVKPRRERPSEAAIREKVHELLKLVQLDWLAQRYPSELSGGQRQRIALARALAVEPKVLLLDEPFGALDAKVRKELRGWLRRLHDDLHISTIFVTHDQEEALEVADRIVVLNRGHVEQVGSPQDVYDHPQSAFVYEFLGAANRLPGTVAGRGFVAEGAAAPTEVD

SEQ ID NO: 12755 - protein, 168 aa, Brassica oleracea
MLVYTDLLTGDELLSDSFPYKEIENGILWEVEGKWTTKGCVEVNIGANPSAEEGGEDEGVDDSVEKVVDIVDTFRLQEQPTYDKKGFIAYIKKYIKLLTPKLTPEQQEEFKKGIEGATKFLLPKLKDFQFFVGEGMHDDSTIVFAYYKEGATNPTFLYFAHGLKEVKC

SEQ ID NO: 12756 - protein, 233 aa, Bacillus subtilis
MGKGKVMDSYQDAAALIKDGDTLIAGGFGLCGIPEQLILAIRDSGVKNLTVVSNNCGVDDWGLGLLLANRQIKKMVASYVGENKTFERQFLSGELEVELVPQGTLAERIRAGGAGIPAFYTPAGVGTSVAEGKEHKTFDGRTYLLEKGVTGNVAIVKAWKADPLGNLMFRKTARNFNPLAAMAGKVTIAEAEEIVDAGELDPDQIHTPGIFVQHVLLGGIHEKRIERCTVRQA

SEQ ID NO: 12757 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALAIHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGAAFSKIGKEFVPVYLHRDYLNLGERAVNVSKEDQNCASFVEVGQPIDYCQLRISDETNERVEDGIIGHIQIKGDNVTQGYYNNPESTEKVLTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLNGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSAMNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAEFTSGDEPLRGGVSSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEDEKRGEAALNINQSKAHIESFLKTVISNASGIRAEELDLNAHFIGLGMDSIMLSQVKKAIADEFGVDIPMDRFFDTLTNLQSVIDYLADTVPSSFASAPPQENVPAQEIQVISEAQSESDRREGHQEHMLEKIIASQNQLIQDTLQAQLNSFNLLRNSGHHSDEKEYAKAQEKSIPSVKQGPPTVTAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGEMQYTSLKQAVRHIVDRHEALRTVIHPDDEVQQVLERMNIDIPVIDFTGHPHEHREPEIQKWLTEDAKRPFHFHEQKPLFRIHVLTSAHNEHLIVLTFHHIIADGWSIAVFVQELESNYAAIVQGKPISPKEADVSFRQYLDWQQAQIDSGHYEEGVRYWRRHFSEPIQQPILPSTASIRYPNGYEGDRCTVRLGRPLSEALRSLSIQMKNSVFVTMLGAFHLFLHQLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQHALQALYAEHQKRVSSIGSNTANFTEAYEAPVNETERQLARIWEELFGLERVGRSDRFLALGGNSLQATLMLSKVQKTFHQKVSIGQFFNHQTVKELARFIQNETKVVHLPMKAAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSKAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPENRIQYMLRDSRAEVVLTQRSLLDQLPYDGDVVLLDEENSYHEEHSNFESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGDTAIRKMIVGGENLSTRLAKSVSEQFKGRLDIFNEYGPTEAVVGCMIYHFDAVRDKREFVPIGTPAANTDIYVADASRNLVPIGVIGEIYISGPGVARGYWNRPDLTEEKFVENPYVPGAKMYKSGDLAKRLKDGNLVYIGRVDEQVKIRGHRIELGEIEAAMHNAEAVQKAAVTVKEEEDGLKQLCAYYVSDKPIAAAQLREQLSSGLPDYMVPSYFVRLEHMPLTSNGKINRKALPAPESSLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMKVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPGPLSIQYKDFAVWQQSDLQKRNIKSQEAYWLDQFHGDIPVLDIPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELIFDSLQLKPYPFHHSVAKFDLTLSIQADRDNYYGLFEYSKKLFKKSRIEVLSNDYLHILSAILEQPSILIEHIGLSGSNEEEENALDSIQLNF

SEQ ID NO: 12758 - protein, 262 aa, Cynodon dactylon
MLAVVAVVLASMVGGALCAMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSNPNYLALLVKYAAGDGNIVSVDIKSKGSDEFLPMKQSWGAIWRIDPPKPLKGPFTIRLTSESGGHVEQEDVIPEDWKPDTVYKSKIQF

SEQ ID NO: 12759 - protein, 262 aa, Cynodon dactylon
MLAAVAVVLASMVGGAWCAMGDKPGPNITATYGDKWLDAKATFYGSDPRGAAPDDHGGACGYKDVDKAPFDGMTGCGNEPIFKDGLGCGSCYEIKCKEPAECSGEPVLIKITDKNYEHIAAYHFDLSGKAFGAMAKKGEEDKLRKAGELMLQFRRVKCEYPSDTKITFHVEKGSSPNYLALLVKYAAGDGNIVGVDIKPKGSDVFLPMKLSWGAIWRMDPPKPLKGPFTIRLTSESGGHVEQEDVIPEDWKPDTVYKSKIQF

SEQ ID NO: 12760 - protein, 262 aa, Cynodon dactylon
MLAVVAVVLASMVGGALCAMGDKPGPNITATYGDKWLDAKATFYGSDPRGAAPDDHGGACGYKDVDKAPFDSMTGCGNEPIFKDGLGCGSCYEIKCKEPAECSGEPVLIKITDKNYEHIAAYHFDLSGKAFGAMAKKGEEDKLRKAGELMLQFRRVKCEYPSDTKIAFHVEKGSNPNYLALLVKYAAGDGNIVSVDIKSKGSDEFLPMKQSWGAIWRIDPPKPLKGPFTIRLTSESGGHVEQEDVIPEDWKPDTVYKSKIQF

SEQ ID NO: 12761 - protein, 308 aa, Bacillus subtilis subsp. subtilis str. 168
MVRVANSITELIGNTPIVKLNRLADENSADVYLKLEYMNPGSSVKDRIGLAMIEAAEKEGKLKAGNTIIEPTSGNTGIGLAMVAAAKGLKAILVMPDTMSMERRNLLRAYGAELVLTPGAEGMKGAIKKAEELAEKHGYFVPQQFNNPSNPEIHRQTTGKEIVEQFGDDQLDAFVAGIGTGGTITGAGEVLKEAYPSIKIYAVEPSDSPVLSGGKPGPHKIQGIGAGFVPDILNTEVYDEIFPVKNEEAFEYARRAAREEGILGGISSGAAIYAALQVAKKLGKGKKVLAIIPSNGERYLSTPLYQFD

SEQ ID NO: 12762 - protein, 458 aa, Bacillus subtilis subsp. subtilis str. 168
MAKTKSKFICQSCGYESPKWMGKCPGCGAWNTMVEEMIKKAPANRRAAFSHSVQTVQKPSPITSIETSEEPRVKTQLGEFNRVLGGGVVKGSLVLIGGDPGIGKSTLLLQVSAQLSGSSNSVLYISGEESVKQTKLRADRLGINNPSLHVLSETDMEYISSAIQEMNPSFVVVDSIQTVYQSDITSAPGSVSQVRECTAELMKIAKTKGIPIFIVGHVTKEGSIAGPRLLEHMVDTVLYFEGERHHTFRILRAVKNRFGSTNEMGIFEMREEGLTEVLNPSEIFLEERSAGSAGSSITASMEGTRPILVEIQALISPTSFGNPRRMATGIDHNRVSLLMAVLEKRVGLLLQNQDAYLKVAGGVKLDEPAIDLAIVISIASSFRDTPPNPADCFIGEVGLTGEVRRVSRIEQRVKEAAKLGFKRMIIPAANLDGWTKPKGIEVIGVANVAEALRTSLGG

SEQ ID NO: 12763 - protein, 143 aa, Bacillus subtilis subsp. subtilis str. 168
MLEFDTIKDSKQLNGLALAYIGDAIFEVYVRHHLLKQGFTKPNDLHKKSSRIVSAKSQAEILFFLQNQSFFTEEEEAVLKRGRNAKSGTTPKNTDVQTYRYSTAFEALLGYLFLEKKEERLSQLVAEAIQFGTSGRKTNESAT

SEQ ID NO: 12764 - protein, 462 aa, Bacillus subtilis subsp. subtilis str. 168
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 12765 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 12766 - protein, 327 aa, Bacillus subtilis subsp. subtilis str. 168
MKELIKEHQKDINPALQLHDWVEYYRPFAANGQSANYIPALGKVNDSQLGICVLEPDGTMIHAGDWNVSFTMQSISKVISFIAACMSRGIPYVLDRVDVEPTGDAFNSIIRLEINKPGKPFNPMINAGALTIASILPGESAYEKLEFLYSVMETLIGKRPRIHEEVFRSEWETAHRNRALAYYLKETNFLEAEVEETLEVYLKQCAMESTTEDIALIGLILAHDGYHPIRHEQVIPKDVAKLAKALMLTCGMYNASGKYAAFVGVPAKSGVSGGIMALVPPSARREQPFQSGCGIGIYGPAIDEYGNSLTGGMLLKHMAQEWELSIF

SEQ ID NO: 12767 - protein, 488 aa, Bacillus subtilis subsp. subtilis str. 168
MSVITEQNTYLNFINGEWVKSQSGDMVKVENPADVNDIVGYVQNSTAEDVERAVTAANEAKTAWRKLTGAERGQYLYKTADIMEQRLEEIAACATREMGKTLPEAKGETARGIAILRYYAGEGMRKTGDVIPSTDKDALMFTTRVPLGVVGVISPWNFPVAIPIWKMAPALVYGNTVVIKPATETAVTCAKIIACFEEAGLPAGVINLVTGPGSVVGQGLAEHDGVNAVTFTGSNQVGKIIGQAALARGAKYQLEMGGKNPVIVADDADLEAAAEAVITGAFRSTGQKCTATSRVIVQSGIYERFKEKLLQRTKDITIGDSLKEDVWMGPIASKNQLDNCLSYIEKGKQEGASLLIGGEKLENGKYQNGYYVQPAIFDNVTSEMTIAQEEIFGPVIALIKVDSIEEALNIANDVKFGLSASIFTENIGRMLSFIDEIDAGLVRINAESAGVELQAPFGGMKQSSSHSREQGEAAKDFFTAIKTVFVKP

SEQ ID NO: 12768 - protein, 310 aa, Bacillus subtilis subsp. subtilis str. 168
MDQTRTLGKTKLKVKRIGFGANAVGGHNLFPNLNDETGKDLVRTALDGGVNFIDTAFIYGLGRSEELIGEVVQERGVRNELIIATKGAHKEVDGSIELDNSREFLRSEVEKSLKRLKTDYIDLYYVHFPDGKTPLAEVAGTLKELKDEGKIKAIGASNLDYQQLQDFNADGYLEVFQAEYSLIQRDAEKELLPYCEKQGISFIPYFPLASGLLTGKFTQDTVFDDFRKDKPQFQGETFIHNLKKVDKLKAVAEEKQADTAHVALAWLLTRPAIDAIIPGAKRPEQLQDNLKTLNIELTEDEVNFISDIFK

SEQ ID NO: 12769 - protein, 400 aa, Bacillus subtilis subsp. subtilis str. 168
MGKQQPISQRKLLGVAGLGWLFDAMDVGILSFIIAALHVEWNLSPEEMKWIGSVNSIGMAAGAFLFGLLADRIGRKKVFIITLLCFSIGSGISAFVTSLSAFLILRFVIGMGLGGELPVASTLVSEAVVPEKRGRVIVLLESFWAVGWLAAALISYFVIPSFGWQAALLLTALTAFYALYLRTSLPDSPKYESLSAKKRSMWENVKSVWARQYIRPTVMLSIVWFCVVFSYYGMFLWLPSVMLLKGFSMIQSFEYVLLMTLAQLPGYFSAAWLIEKAGRKWILVVYLIGTAGSAYFFGTADSLSLLLTAGVLLSFFNLGAWGVLYAYTPEQYPTAIRATGSGTTAAFGRIGGIFGPLLVGTLAARHISFSVIFSIFCIAILLAVACILIMGKETKQTELE

SEQ ID NO: 12770 - protein, 377 aa, Bacillus subtilis subsp. subtilis str. 168
MSLNSSPSYRRRAGKGLVLCVCRKAFGKWAGFSNGWVYWTSEMLITGSQLTAISLFTKHWFPQVPLWVFASIYAVLGLLIIFTGLAVFEKTENVLAVIKTAAIFMFIVIAILALCGILSGGNHGIHVPNKTSEFFPYGAMGLWTGLIYAFYAFGGIEVMGLMAVHLKKPEEASKSGKLMLATLAIIYIISIGLALLLVPLHTFTEQDSPFITSLKGYNLEIILDIFNGIFIIAGFSTLIASLFAVTTLLCTMADDGDAPKCFTLKEGKKICWPALGLTFAGLVLSIILSLVLPKNIYEHMTTAAGLMLLYTWLFILFSSKKLTDPEGMGKTQIYLAMVLIAAAVSGTLFEKSSRPGFFVSIGFLVIIAIVTMIYQKK

SEQ ID NO: 12771 - protein, 477 aa, Bacillus subtilis subsp. subtilis str. 168
MIHQHPESFPKHFLWGSASAAYQIEGAWNEDGKGPSVWDVFTKIPGKTFKGTNGEIAVDHYHRFKEDVALMAEMGLKAYRFSVSWPRVFPKGKGEINEAGLAFYDSLIDELLSHHIEPVLTLYHWDLPQALMDEYGGFESRNIIEDFNHYCITLYKRFGDRVKYWVTLNEQNYNFNHGFITAMHPPGVKDRKRFYEANHIAFLANAKAIESFREYVPEGKIGPSFAYSPAYPLSSHPEDILAFENAEEFTNNWWLDMYCWGTYPQIPFRCLEKQGWAPTIEAGDMDLLAKGKPDFVGVNYYQTITYERNPLDGVSEGKMNTTGQKGTNQETGIPGVFKTKKNPHLTTSNWDWTIDPIGLRIGLRRITSRYQLPVFITENGLGEFDKVEDGTVQDDYRIDYLRSHLEQCRQAISDGVDLIGYCSWSFTDLLSWLNGYQKRYGFVYVNRDEESTSDLKRLKKKSFYWYQDVIKTNGESL

SEQ ID NO: 12772 - protein, 436 aa, Bacillus subtilis subsp. subtilis str. 168
MSQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 12773 - protein, 462 aa, Bacillus subtilis subsp. subtilis str. 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 12774 - protein, 458 aa, Bacillus subtilis subsp. subtilis str. 168
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 12775 - protein, 465 aa, Bacillus subtilis subsp. subtilis str. 168
MAHTEQYRFPKDFWWGSSASATQMEGAADRDGKGQNIWDYWFEKEPHRFFDHVGPADTSQFYDNYKEDIRLMKELGHNSFRMSISWSRLIPNGTGEINDKAADFYNNVIDELIANGIEPFVNLFHFDMPMALQKIGGWVNRETVDAYENYARTCFRLFGGRVKKWFTHNEPIVPVEGGYLYDFHYPNKVDFKEAVQVGFHTMLSSARAIQAYREMKQDGKIGIILNLTPSYPRSSHPADVKAGEIADAFFNRSFLDPSVKGEFPKELVDILKHEGFMPDYNAEDLDIIKKNTVDLLGVNYYQPRRVKAKEHLPNPDAPFLPDRYFDPYVMPGRKMNPHRGWEIYEKGVYDILINLKENYGNIECFISENGMGVEGEERFRDEQGIIQDDYRIEFIKEHLKWIHRAIQEGSNVKGYHLWTFMDNWSWTNAYKNRYGFVSVNLEKDGERTVKKSGKWFKEVAEHSGF

SEQ ID NO: 12776 - protein, 320 aa, Bacillus subtilis subsp. subtilis str. 168
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 12777 - protein, 473 aa, Bacillus subtilis subsp. subtilis str. 168
MNKQGNQMSFLRTIILVSTFGGLLFGYDTGVLNGALPYMGEPDQLNLNAFTEGLVTSSLLFGAALGAVFGGRMSDFNGRRKNILFLAVIFFISTIGCTFAPNVTVMIISRFVLGIAVGGASVTVPAYLAEMSPVESRGRMVTQNELMIVSGQLLAFVFNAILGTTMGDNSHVWRFMLVIASLPALFLFFGMIRMPESPRWLVSKGRKEDALRVLKKIRDEKRAAAELQEIEFAFKKEDQLEKATFKDLSVPWVRRIVFIGLGIAIVQQITGVNSIMYYGTEILRNSGFQTEAALIGNIANGVISVLATFVGIWLLGRVGRRPMLMTGLIGTTTALLLIGIFSLVLEGSPALPYVVLSLTVTFLAFQQGAISPVTWLMLSEIFPLRLRGLGMGVTVFCLWMVNFAVSFTFPILLAAIGLSTTFFIFVGLGICSVLFVKRFLPETKGLSLEQLEENFRAYDHSGAKKDSGAEVIG

SEQ ID NO: 12778 - protein, 469 aa, Bacillus subtilis subsp. subtilis str. 168
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 12779 - protein, 440 aa, Bacillus subtilis subsp. subtilis str. 168
MKTFFQFDELGTSYRNEIIGGLTTFLSMAYILFVNPITLALESVKDFPEALRIDQGAVFTATALASAAGCILMGLIARYPIAIAPGMGLNAFFAFSVVLGMGISWQAALSGVFISGLIFVALSLTGFREKIINAIPPELKLAVGAGIGLFITFVGLQGSGIITANPSTLVTIGNIHSGPVLLTIFGVIVTVILMVLRVNAGVFIGMLLTAVAGMIFGLVPVPTQIIGSVPSLAPTFGQAWIHLPDIFSVQMLIVILTFLFVGFFDTAGTLVAVATQAGLMKENKLPRAGRALLADSSSIVIGAVLGTSTTTSYVESSSGVAAGARSGFAAIVTGILFLLATFFSPLLSVVTSNVTAPALIIVGALMVAPLGKIAWDKFEVAVPAFLTMIMMPLTYSIATGIAIGFIFYPITMVCKGKAKEVHPIMYGLFVVFILYFIFLK

SEQ ID NO: 12780 - protein, 1061 aa, Bacillus subtilis subsp. subtilis str. 168
MKETSPIPQPKTFGPLGNLPLIDKDKPTLSLIKLAEEQGPIFQIHTPAGTTIVVSGHELVKEVCDEERFDKSIEGALEKVRAFSGDGLFTSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAGI

SEQ ID NO: 12781 - protein, 461 aa, Bacillus subtilis subsp. subtilis str. 168
MSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 12782 - protein, 458 aa, Bacillus subtilis subsp. subtilis str. 168
MTLAIIGGGPAGYAAAVSAAQQGRNVLLIDKGKLGGTCLNEGCIPTKSLLESANVLDKIKHADSFGIELPAGAISVDWSKMQSRKQQVVSQLVQGVQYLMKKNQIQVVKGTASFLSERKLLIEGENGKEIREADQVLIASGSEPIELPFAPFDGEWILDSKDALSLSEIPSSLVIVGGGVIGCEYAGLFARLGSQVTIIETADRLIPAEDEDIARLFQEKLEEDGVEVHTSSRLGRVDQTAKTAIWKSGQREFKTKADYVLVAIGRKPRLDGLQLEQAGVDFSPKGIPVNGHMQTNVPHIYACGDAIGGIQLAHAAFHEGIIAASHASGRDVKINEKHVPRCIYTSPEIACIGMTERQARSIYGDVKIGEFSFSANGKALIKQQAEGKVKIMAEPEFGEIVGVSMIGPDVTELIGQAAAIMNGEMTADMAEHFIAAHPTLSETLHEALLSTIGLAVHA

SEQ ID NO: 12783 - protein, 482 aa, Bacillus subtilis subsp. subtilis str. 168
MSTKKKEAVIGKESLAHKGLLRTITLVSTFGGLLFGYDTGVINGALPFMATAGQLNLTPVTEGLVASSLLLGAAFGAMFGGRLSDRHGRRKTILYLALLFIAATLGCTFSPNASVMIAFRFLLGLAVGCASVTVPTFLAEISPAERRGRIVTQNELMIVIGQLLAYTFNAIIGSTMGESANVWRYMLVIATLPAVVLWFGMLIVPESPRWLAAKGRMGDALRVLRQIREDSQAQQEIKEIKHAIEGTAKKAGFHDFQEPWIRRILFIGIGIAIVQQITGVNSIMYYGTEILREAGFQTEAALIGNIANGVISVIAVIFGIWLLGKVRRRPMLIIGQIGTMTALLLIGILSIVLEGTPALPYVVLSLTILFLAFQQTAISTVTWLMLSEIFPMHVRGLGMGISTFCLWTANFLIGFTFPILLNHIGMSATFFIFVAMNILAILFVKKYVPETKGRSLEQLEHSFRQYGRRADQEIQNQTTHLS

SEQ ID NO: 12784 - protein, 450 aa, Bacillus subtilis subsp. subtilis str. 168
MEMMGMENIQQNQGLKQKDEQFVWHAMKGAHQADSLIAQKAEGAWVTDTDGRRYLDAMSGLWCVNIGYGRKELAEAAYEQLKELPYYPLTQSHAPAIQLAEKLNEWLGGDYVIFFSNSGSEANETAFKIARQYHLQNGDHSRYKFISRYRAYHGNTLGALSATGQAQRKYKYEPLSQGFLHAAPPDIYRNPDDADTLESANEIDRIMTWELSETIAGVIMEPIITGGGILMPPDGYMKKVEDICRRHGALLICDEVICGFGRTGEPFGFMHYGVKPDIITMAKGITSAYLPLSATAVKRDIFEAYQGEAPYDRFRHVNTFGGSPAACALALKNLQIMEDEQLIQRSRDLGAKLLGELQALREHPAVGDVRGKGLLIGIELVKDKLTKEPADAAKVNQVVAACKEKGLIIGKNGDTVAGYNNVIHVAPPFCLTEEDLSFIVKTVKESFQTI

SEQ ID NO: 12785 - protein, 331 aa, Bacillus subtilis subsp. subtilis str. 168
MEYTSIADTGIEASRIGLGTWAIGGTMWGGTDEKTSIETIRAALDQGITLIDTAPAYGFGQSEEIVGKAIKEYGKRDQVILATKTALDWKNNQLFRHANRARIVEEVENSLKRLQTDYIDLYQVHWPDPLVPIEETAEVMKELYDAGKIRAIGVSNFSIEQMDTFRAVAPLHTIQPPYNLFEREMEESVLPYAKDNKITTLLYGSLCRGLLTGKMTEEYTFEGDDLRNHDPKFQKPRFKEYLSAVNQLDKLAKTRYGKSVIHLAVRWILDQPGADIALWGARKPGQLEALSEITGWTLNSEDQKDINTILENTISDPVGPEFMAPPTREEI

SEQ ID NO: 12786 - protein, 513 aa, Bacillus subtilis subsp. subtilis str. 168
MNLVSKLEETASEKPDSIACRFKDHMMTYQELNEYIQRFADGLQEAGMEKGDHLALLLGNSPDFIIAFFGALKAGIVVVPINPLYTPTEIGYMLTNGDVKAIVGVSQLLPLYESMHESLPKVELVILCQTGEAEPEAADPEVRMKMTTFAKILRPTSAAKQNQEPVPDDTAVILYTSGTTGKPKGAMLTHQNLYSNANDVAGYLGMDERDNVVCALPMCHVFCLTVCMNAPLMSGATVLIEPQFSPASVFKLVKQQQATIFAGVPTMYNYLFQHENGKKDDFSSIRLCISGGASMPVALLTAFEEKFGVTILEGYGLSEASPVTCFNPFDRGRKPGSIGTSILHVENKVVDPLGRELPAHQVGELIVKGPNVMKGYYKMPMETEHALKDGWLYTGDLARRDEDGYFYIVDRKKDMIIVGGYNVYPREVEEVLYSHPDVKEAVVIGVPDPQSGEAVKGYVVPKRSGVTEEDIMQHCEKHLAKYKRPAAITFLDDIPKNATGKMLRRALRDILPQ

SEQ ID NO: 12787 - protein, 398 aa, Bacillus subtilis subsp. subtilis str. 168
MKFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 12788 - protein, 178 aa, Bacillus subtilis subsp. subtilis str. 168
MATIRIHDEANTTIENQEEVASFLDSQEVIYEQWDITRLPEHLSEKYDLTEEEKQQILDTFETEIKDISTRRGYKAQDVISLSDSNPKLDELLENFKREHHHTDDEVRFIVSGHGIFVIQGQDGTFFDVRLNPGDLISVPENIRHYFTLQEDRKVVAVRIFVTTEGWVPIYEKDSVNQ

SEQ ID NO: 12789 - protein, 288 aa, Bacillus subtilis subsp. subtilis str. 168
MKKTIGFIGLGVMGKSMASHILNDGHPVLVYTRTKEKAESILQKGAIWKDTVKDLSKEADVIITMVGYPSDVEEVYFGSNGIIENAKEGAYLIDMTTSKPSLAKKIAEAAKEKALFALDAPVSGGDIGAQNGTLAIMVGGEKEAFEACMPIFSLMGENIQYQGPAGSGQHTKMCNQIAIAAGMIGVAEAMAYAQKSGLEPENVLKSITTGAAGSWSLSNLAPRMLQGNFEPGFYVKHFIKDMGIALEEAELMGEEMPGLSLAKSLYDKLAAQGEENSGTQSIYKLWVK

SEQ ID NO: 12790 - protein, 309 aa, Bacillus subtilis subsp. subtilis str. 168
MVCQHNDELEALVKKAKKVTDKGEVASYIPALAKADKHDLSVAIYYSNNVCLSAGDVEKTFTLQSISKVLSLALVLMEYGKDKVFSYVGQEPTGDPFNSIIKLETVNPSKPLNPMINAGALVVTSLIRGRTVKERLDYLLSFIRRLTNNQEITYCREVAESEYSTSMINRAMCYYMKQYGIFEDDVEAVMDLYTKQCAIEMNSLDLAKIGSVFALNGRHPETGEQVISKDVARICKTFMVTCGMYNASGEFAIKVGIPAKSGVSGGIMGISPYDFGIGIFGPALDEKGNSIAGVKLLEIMSEMYRLSIF

SEQ ID NO: 12791 - protein, 217 aa, Bacillus subtilis subsp. subtilis str. 168
MIKVAPSILSADFAALGNEIKDVEKGGADCIHIDVMDGHFVPNITIGPLIVEAVRPVTDLPLDVHLMIEEPDRYIPAFAKAGADILSVHAEACPHLHRTIQLIKEQGVKAGVVLNPHTPVQVIEHVFDDLDLVLLMTVNPGFGGQKFIHSVLPKIKEVKRMADEKGKKDLLIEVDGGVNKETAPLVIEAGANLLVAGSAVYGQSDRKKAISEIRGSK

SEQ ID NO: 12792 - protein, 419 aa, Bacillus subtilis subsp. subtilis str. 168
MDMNEHRNRRLKLIMISATFGGLLFGYDTGVINGALPFMARPDQLDLTPVTEGLVTSILLLGAAFGALLCGRLADRDRRRKMILNLSFLFFLASLGTALAPNVFIMAVFRFLLGLAVGGASAMVPAFLAEMAPHEKRGRMVTQNELMIVGGQFLAYVFNAILGVTMANTGHVWRYMLVICAVPAIMLFASMLKVPESPRWLISKGKNSEALRVLKQIREDKRAEAECREIQEAVEKDTALEKASLKDFSTPWLRRLLWIGIGVAIVNQITGVNSIMYYGTQILKESGFGTKAALIANIGNGLISVIAVIFGIWLVGKVRRRPILLIGLAGTTTALLLIAIFSIVLDGSMALPYVVLSLTVLFLAFMQGCVGPVTWLVIAEIFPQRLRGLGSGISVFFLWILNFVIGFAFPILLSSVGLS

SEQ ID NO: 12793 - protein, 463 aa, Bacillus subtilis subsp. subtilis str. 168
METSQEPLVTQKKSKPSVWRSMSLFLVPLLLSNVLQSVGQLVGMMAVGRWLGVDAVAAVSSFFPLFFLLISFTIGIGSGSSILIGQAYGAKNEERLKAVVGTTLTFTFLLGVVLAVIGSIFTLDILRLMGTPENVIHVSANYARILFYAMPFMFLYFAYTTFLRGTGDSKTPFYTLIVSTVINIALLPVLILGMFGFPKLGIYGSAYATVISTIATFLVLMVYLRKRKHPLQFDKTVRRYLKMDKELLVLLLRLGVPASINMILVSLSEIAVISFVNHYGSNATAAYGVVNQVASYVQMPAVSLGIAVSIFAAQSIGANEFDRLKQVIRVGIWLNYIIGGVLIILIYVFSHQILSLFLTEQESLYIAHRLLMTTLWSYLLFGNAQIISATMRASGTVLWPTVISIFAIWGVEVPVAFVLSHYTKLEILGVWVGYPAAFAVSLLLIYGYYQFVWKKKQITRLIQ

SEQ ID NO: 12794 - protein, 329 aa, Bacillus subtilis subsp. subtilis str. 168
MKAVIHNGKAGLLGLSVQDVPSTKPGYGEVKVKLKSAGLNHRDLFLMKNKSEQDPHMILGSDGAGIIEEIGEGVKNVTVQTEVVIFPTLNWDLTENVPPVPEILGGPSDGTLAEYVIIPSQNAIKKPAYLSWEEAGVLPLSALTAYRALFTKGQLKKGEHLLIPGIGSGVATYALFMAKAIGATVSVTSRSEEKRKKALKLGADYAFDSYSNWDEQLQGKKIDVVLDSIGPALFSEYFRHVKPNGRIVSFGASSGDNLSFPVRSLFFPQVNVLGTSMGSGEEFQAMLAFIDKHKLRPVIDRIYPLEKACEAYKRMQEGRQFGNIGIVME

SEQ ID NO: 12795 - protein, 493 aa, Bacillus subtilis subsp. subtilis str. 168
MGKPTGFMEIKREKPAERDPLTRLKDWKEYSAPFSEEASKRQGARCMDCGTPFCQIGADINGFTSGCPIYNLIPEWNDLVYRGRWKEALERLLKTNNFPEFTGRVCPAPCEGSCTLAISDPAVSIKNIERTIIDKGFENGWIQPRIPKKRTGKKVAIVGSGPAGLASADQLNQAGHSVTVFERADRAGGLLTYGIPNMKLEKGIVERRIKLLTQEGIDFVTNTEIGVDITADELKEQFDAVILCTGAQKQRDLLIEGRDSKGVHYAMDYLTLATKSYLDSNFKDKQFIDAKGKDVIVIGGGDTGADCVATALRQKAKSVHQFGKHPKLPPARTNDNMWPEQPHVFTLEYAYEEREAKFGRDPREYSIQTTKMVADKNGKLKELHTIQMEKVKNEHGKYEFRELPGTEKVWPAQLVFIAIGFEGTEQPLLKQFGVNSVNNKISAAYGDYQTNIDGVFAAGDARRGQSLIVWAINEGREVAREVDRYLMGSSVLP

SEQ ID NO: 12796 - protein, 495 aa, Bacillus subtilis subsp. subtilis str. 168
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 12797 - protein, 321 aa, Bacillus subtilis subsp. subtilis str. 168
MDIIRKISHFAGQTFGIWVIVFAVLGFSFPSLFTWISSYITIFLGIIMFGMGLTLQADDFKELVRKPWQVIIGVIAQYTIMPLVAFGLAFGLHLPAEIAVGVILVGCCPGGTASNVMTFLAKGNTALSVAVTTISTLLAPVVTPLLIMLFAKEWLPVSPGSLFISILQAVLFPIIAGLIVKMFFRKQVAKAVHALPLVSVIGIVAIVSAVVSGNRENLLQSGLLIFSVVILHNGIGYLLGFLCAKLLKMDYPSQKAIAIEVGMQNSGLGAALATAHFSPLSAVPSAIFSVWHNLSGSMLATYWSKKVKKKQAGSKSSNLSL

SEQ ID NO: 12798 - protein, 452 aa, Bacillus subtilis subsp. subtilis str. 168
MKETQNAREKIKQLLHILIPIFITQAGLSLITFLDTVMSGKVSPADLAGVAIGSSLWTPVYTGLAGILMAVTPIVAQLLGAEKKQKIPFTVLQAVYVAALLSIAVLVIGYAAVDLILGRLNLDIHVHQIAKHFLGFLSLGIFPLFVYTVLRSFIDSLGKTRVTMMITLSSLPINFVLNYVFIFGKFGMPALGGVGAGLASALTYWCICIISFFIIHKNAPFSEYGIFLTMYKFSWKACKNLLKIGLPIGFAVFFETSIFAAVTLLMSHFHTVTIASHQAAMNFASLLYMLPLSVSMALTIVVGFEAGAARFKDARSYSLIGIMMAIGFSLFTAACILLFREQIAGMYTSDPDVLRLTQHFLIYALFFQLSDAVAAPIQGALRGYKDVNYTLAAAFVSYWVIGLPVGYMVGTFTSLGAFGYWIGLIAGLAAGAVGLFFRLAKLQKRYSQKQHI

SEQ ID NO: 12799 - protein, 229 aa, Bacillus subtilis subsp. subtilis str. 168
MAPFQKAISIDTAIADVRDGSVLMFGGFGGVGSPPSLIEAILDSGVTDLTVICNDAGFPDIGIGPLIVNQRVKTLIASHIGSNPVAGKQMTEGTLEVQFSPQGTLAERIRAGGAGLGGILTDVGIDNQMVCEKKDIVTVAGKRYLIEEALTADFAFINAYIADEFGNLTYDKTARNMNPLMAMAARRTFAEAERIVPMGEISEEMIVTPGVFVEGVVRSEGVKWKWAWE

SEQ ID NO: 12800 - protein, 444 aa, Bacillus subtilis subsp. subtilis str. 168
MSSYLIKPELSSAYPVVSYAKGSYVYDQTGKKYLDGSSGAVTCNIGHGVRDVTEKLKEQLDQVSFAYRSQFTSEPAEQLAALLAQELPGDVNWSFFVNSGSEAIETAMKIAIQYWQEKKQTQKSIFLSRWSSYHGITLGALSLSGFYERRYRFTHLIERYPAISAPHIYRLNHETEEDFVQTAADELDTMIKRIGSQFIAGFVAEPIIGAAGAAITPPPGYYERLSEVCRTHDVLFIADEVMTGLGRTGRMLATEHWDTVPDIAVLGKGLGAGYAPIAAAVVSDSIIETIKQGSGVIMSGHTYSAHPYSAKAALEVLRYVLKHGLIKQSEKKGAVLKKKLDEAASQSGIIGEVRGKGLLLGIEFVADQKTKKVFPPEQAITQLIVSEAKKRGLIVYPSKAGIDSGEGDAVIIAPPFTISDGEMEELISIFSETVAAVEKNLKKD

SEQ ID NO: 12801 - protein, 445 aa, Bacillus subtilis subsp. subtilis str. 168
MKAYDFTQGNVLKQLVLFSMPIMLGNALQVSFQFIDSLWIGNLLGAKALGAAAVSSTIVLTVLSFILGLNNATLTILSQQKGKDDIKGMASYINAFVVLLTGLSIGFGAAGFFLSELLLRLLKTPESMIPLAETYLQIQFIGILFLFGYNFISTVLRALGDSKTPLRFIAFAVVLNTVLAPLFISVFRMGIAGAAYSTILSQGIAFLYGLFYVIKHKLVPFSIPRMPKWEESALILKLGIPAGLQMMVITGGMMAIMSVVNSYGDHVVSGFGAVQRLDSIITLPAMAAGTAVNSMAGQNIGIGNEKRVGTIARLGVIAVISCMLVIAVMIWVFGKYLIRLFISEPDAVAFGEQYLKWIAFFYPFIGVNFVLNGIVRAAGAMLQVLVLNLISFWVLRYPFTALFSAWLGQKGIGLGIGMSFLFSSCAAFLYYRYGRWKAMKLFTEK

SEQ ID NO: 12802 - protein, 160 aa, Bacillus subtilis subsp. subtilis str. 168
MSIYHMKVRTITGKDMTLQPFAGKVLMIVNTASKCGFTSQLKQLQELYDTYQQEGLEILGFPCNQFMNQEPGEEADIQEFCETNYGVTFPMFSKVDVNGKNAHPLFVYLTEHAKGMLGTKAIKWNFTKFIVDRNGEIVGRYSPNTNPKELEDDIVKLLEQ

SEQ ID NO: 12803 - protein, 324 aa, Bacillus subtilis subsp. subtilis str. 168
MKLDAVTFGESMAMFYANEYGGLHEVSTFSKGLAGAESNVACGLARLGFRMGWMSKVGNDQLGTFILQELKKEGVDVSRVIRSQDENPTGLLLKSKVKEGDPQVTYYRKNSAASTLTTAEYPRDYFQCAGHLHVTGIPPALSAEMKDFTYHVMNDMRNAGKTISFDPNVRPSLWPDQATMVHTINDLAGLADWFFPGIAEGELLTGEKTPEGIADYYLKKGASFVAIKLGKEGAYFKTGTSEGFLEGCRVDRVVDTVGAGDGFAVGVISGILDGLSYKDAVQRGNAIGALQVQAPGDMDGLPTREKLASFLSAQRTVHQKKGDY

SEQ ID NO: 12804 - protein, 267 aa, Bacillus subtilis subsp. subtilis str. 168
MSNETIKLVIAGPRGRMGQEAVKLAERTPHFDLVGAIDHTYDQQKLSDVMPVESDAFIYTDIHACFTETQPDVLIDLTTPEIGKVHTKIALEHGVRPVVGTTGFSEADLKELTSLTEEKGIGAIIAPNFALGAILMMKFSKMAANYFEDVEIIELHHDQKLDAPSGTALKTAEMISEVRKEKQQGHPDEKEILPGARGAEQNGIRLHSVRLPGLIAHQEVMFGMDGQTLQIRHDSYNRASFMSGVKLSVEQVMKIDQLVYGLENIID

SEQ ID NO: 12805 - protein, 267 aa, Bacillus subtilis subsp. subtilis str. 168
MFKLDLQPSEKLFIPFITAGDPVPEVSIELAKSLQKAGATALELGVAYSDPLADGPVIQRASKRALDQGMNIVKAIELGGEMKKNGVNIPIILFTYYNPVLQLNKEYFFALLRENHIDGLLVPDLPLEESNSLQEECKSHEVTYISLVAPTSESRLKTIIEQAEGFVYCVSSLGVTGVRNEFNSSVYPFIRTVKNLSTVPVAVGFGISNREQVIKMNEISDGVVVGSALVRKIEELKDRLISAETRNQALQEFEDYAMAFSGLYSLK

SEQ ID NO: 12806 - protein, 305 aa, Bacillus subtilis subsp. subtilis str. 168
MKKILLAIGALVTAVIAIGIVFSHMILFIKKKTDEDIIKRETDNGHDVFESFEQMEKTAFVIPSAYGYDIKGYHVAPHDTPNTIIICHGVTMNVLNSLKYMHLFLDLGWNVLIYDHRRHGQSGGKTTSYGFYEKDDLNKVVSLLKNKTNHRGLIGIHGESMGAVTALLYAGAHCSDGADFYIADCPFACFDEQLAYRLRAEYRLPSWPLLPIADFFLKLRGGYRAREVSPLAVIDKIEKPVLFIHSKDDDYIPVSSTERLYEKKRGPKALYIAENGEHAMSYTKNRHTYRKTVQEFLDNMNDSTE

SEQ ID NO: 12807 - protein, 338 aa, Bacillus subtilis subsp. subtilis str. 168
MARKLFTPITIKDMTLKNRIVMSPMCMYSSHEKDGKLTPFHMAHYISRAIGQVGLIIVEASAVNPQGRITDQDLGIWSDEHIEGFAKLTEQVKEQGSKIGIQLAHAGRKAELEGDIFAPSAIAFDEQSATPVEMSAEKVKETVQEFKQAAARAKEAGFDVIEIHAAHGYLIHEFLSPLSNHRTDEYGGSPENRYRFLREIIDEVKQVWDGPLFVRVSASDYTDKGLDIADHIGFAKWMKEQGVDLIDCSSGALVHADINVFPGYQVSFAEKIREQADMATGAVGMITDGSMAEEILQNGRADLIFIGRELLRDPFFARTAAKQLNTEIPAPVQYERGW

SEQ ID NO: 12808 - protein, 506 aa, Bacillus subtilis subsp. subtilis str. 168
MSTWIIFTRNRKQAEEGGGREKLAQQRQKGKLTARERIIFLLDQDSFIELHPFMESQVLTREQRMLGDGVVTGYGTIDGRSVYVFAQDFTVYGGALGETHARKICALMDLAAKNKAPIIGLNDSGGARIQEGVLSLDGYGHIFYRNVLYSGVIPQISVILGPCAGGAVYSPALTDFIFMAEQTGRMFITGPKVIEKVTGEQVDAESLGGAGIHNAVSGNAHFSGHTEKEVLTGVRKLLSYLPLNGRTTEPKPEKEASRPLLNRLVPADTTKPYDVRKVIRELADPQSFFEIQPFFAKNIVIGFARLGEKAIGIVASQPKHLAGSLTIDAADKAARFIRFCDAFDIPLLTVEDVPGFLPGIQQEHNGIIRHGAKLLFAYAEATVPKVTLIIRKAYGGAYVAMNSKAIGADLVFAWPNAEIAVMGPEGAASILYEKEIKASADPQKTKREKTAEYKKQNAGPYKAAACGMVDDIILPEESRGRLIQAFHMLTHKTEERPKKKHGNIPL

SEQ ID NO: 12809 - protein, 240 aa, Bacillus subtilis subsp. subtilis str. 168
MIKVEKLSKSFGKHEVLKNISTTIAEGEVVAVIGPSGSGKSTFLRCLNLLEKPNGGTITIKDTEITKPKTNTLKVRENIGMVFQHFHLFPHKTVLENIMYAPVNVKKESKQAAQEKAEDLLRKVGLFEKRNDYPNRLSGGQKQRVAIARALAMNPDIMLFDEPTSALDPEMVKEVLQVMKELVETGMTMVIVTHEMGFAKEVADRVLFMDQGMIVEDGNPKEFFMSPKSKRAQDFLEKIL

SEQ ID NO: 12810 - protein, 457 aa, Bacillus subtilis subsp. subtilis str. 168
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTISPASNAF

SEQ ID NO: 12811 - protein, 372 aa, Bacillus subtilis subsp. subtilis str. 168
MNPKYKPLFEPFTFKSGVTINNRIAVAPMTHYASNEDGTISEAELDYIIPRSKEMGMVITACANVTPDGKAFPGQPAIHDDSNIPGLKKLAQAIQAQGAKAVVQIHHGGIECPSELVPQQDVVGPSDVFDNGKQIARALTEEEVENIVKAFGEATRRAIEAGFDGVEIHGANGYLIQQFYSPKTNQRTDRWGGSDEKRLAFPLAIVDEVKKAASEHAKGAFLVGYRLSPEEPETPGLTMTETYTLVDALGDKELDYLHISLMDVNSKARRGADPTRTRMDLLNERVGNKVPLIAVGSIHSADDALAVIENGIPLVAMGREILVDPNWTVKVKEGREKQIETVIKGTDKEKYHLPEPLWQAIVNTQGWVPYKD

SEQ ID NO: 12812 - protein, 297 aa, Bacillus subtilis subsp. subtilis str. 168
MKIGLIGLGKMGINIGKQFIDRNHQVVGYDVNQAAVDELKAYGAEGTTNLKEFISLLHPPRILWVMVPHGIVDAVLRDVSPLLSKGDMIIEAGNSHYKESIRRYNQMKEAGIHYLDAGTSGGMEGARHGACFMVGGDHEAWEIVEPLFRDTAVENGYLYAGEAGSGHFLKMIHNGIEYGMMAAIGEGFEVLENSQFDFDYEKVARVWNHGSVIRSWLMGLTERAFAKDAKLDQIKGIMHSSGEGKWTVETALDLQTATPVIAMSLMMRYRSLTDDTFTGKVVAALRNEFGGHATEKK

SEQ ID NO: 12813 - protein, 349 aa, Bacillus subtilis subsp. subtilis str. 168
MCNQHQTRVLSVSHAKAKFEQTTIERRGLRPHDVLIDIKFSGICHSDIHSAFDEWGGGIFPMVPGHEIAGVVTAVGTKVTKLAVGDRVGVGCFVDSCGECEYCLNAEEQFCTKGVVQTYNSVDYDGNPTYGGYSQKIVVTDRFVVRIPDRLEMDVASPLLCAGITTYSPLKHWNVGPGKKVAIVGVGGLGHLAIQFAHAMGAEVTVLSRSMNKKEEALELGANHYYATSDPATFTALAGRFDVILNTVSANLDVDAYLSMLRIDGTLVSVGAPAKPDTYSVFSLIMGRRSIAGSLVGGIQETQEMLDFAAEHGIEPKIEVIGADQVDEAYERILRSDVRYRFVIDISTL

SEQ ID NO: 12814 - protein, 459 aa, Bacillus subtilis subsp. subtilis str. 168
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 12815 - protein, 1054 aa, Bacillus subtilis subsp. subtilis str. 168
MKQASAIPQPKTYGPLKNLPHLEKEQLSQSLWRIADELGPIFRFDFPGVSSVFVSGHNLVAEVCDEKRFDKNLGKGLQKVREFGGDGLFTSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTGM

SEQ ID NO: 12816 - protein, 307 aa, Bacillus subtilis subsp. subtilis str. 168
MTVITDITELIGNTPLLRLKNFDVPEGVAVYAKLEMMNPGGSIKDRLGDMLIRDALDSGKVKPGGVIIEATAGNTGIGLALSARKYGLKAIFCVPEHFSREKQQIMQALGASIIHTPRQDGMQGAIQKAIQLETEIENSYCVLQFKNRVNPSTYYKTLGPEMWEALDGNIHTFVAGAGSGGTFAGTASFLKEKNPAVKTVIVEPVGSILNGGEPHAHKTEGIGMEFIPDYMDKSHFDEIYTVTDENAFRLVKEAAEKEGLLIGSSSGAALYAALEEAKKASAGTNIVTVFPDSSDRYISKQIYEGGI

SEQ ID NO: 12817 - protein, 242 aa, Bacillus subtilis subsp. subtilis str. 168
MITFQNVNKHYGDFHVLKQINLQIEKGEVVVIIGPSGSGKSTLLRCINRLESINEGVLTVNGTAINDRKTDINQVRQNIGMVFQHFHLYPHKTVLQNIMLAPVKVLRQSPEQAKETARYYLEKVGIPDKADAYPSQLSGGQQQRVAIARGLAMKPEVMLFDEPTSALDPEMIGEVLDVMKTLAKEGMTMVVVTHEMGFAKEVADRIVFIDEGKILEEAVPAEFYANPKEERARLFLSRILNH

SEQ ID NO: 12818 - protein, 259 aa, Bacillus subtilis subsp. subtilis str. 168
MIEIKNIHKQFGIHHVLKGINLTVRKGEVVTIIGPSGSGKTTFLRCLNLLERPDEGIISIHDKVINCRFPSKKEVHWLRKQTAMVFQQYHLFAHKTVIENVMEGLTIARKMRKQDAYAVAENELRKVGLQDKLNAYPSQLSGGQKQRVGIARALAIHPDVLLFDEPTAALDPELVGEVLEVMLEIVKTGATMIVVTHEMEFARRVSDQVVFMDEGVIVEQGTPEEVFRHTKKDRTRQFLRRVSPEYLFEPKEHIKEPVI

SEQ ID NO: 12819 - protein, 311 aa, Bacillus subtilis subsp. subtilis str. 168
MLKIVANTADLIGDTPLVRLNRLQPENAAQVYLKLEFFNPSGSVKDRAAYQMIIEAEQNGLLKPGSVIIEPTSGNTGIGLAMNAAARGYKAILVMPDTMTKERINLLKAYGAEVVLTPGEERMPGSIKKAKELAEQIPNSYIPMQFDNTANPDAHRKTTAPEIARAIEEIGKPLGAFVASSGTGGTITGTGEALKELFPDITVHVVEPAGSPVLSGGKPGAHKLVGTSPGFIPPILNEDVYDEIIKISDEDAYTTTRRLAAEEGILVGPSSGAACFAAIETAKRLSPDKVVVCMTADTGERYLSTDLWSFI

SEQ ID NO: 12820 - protein, 432 aa, Bacillus subtilis subsp. subtilis str. 168
MFHLKEQQTSIKQEIIAGLTTFFTMVYIVVVNPVILANAGVPFDQVFTATIIASIVGTLWMALAANYPIAIAPGMGLNAYLAFHVVSASDGGITYATAFSAVFTAGVLFIILSLTPLRKQLIEAIPNNLKYGITTGIGLFIAFIGLRQAGIVAADESNLVTLGNLHSPGVILTLVGLLISVVLMVLNVSGALFIGMAATALIAFFTGQLHFSKGFMSLPHLPEGLMISNPFTAFGDVIHHGLYAVVFSFLLVTIFDTTGTMIGVAEQAGLMKNNKLPNVRKALLADSTATTVGAVFGTSPTTAFIESSAGVAAGGRTGLTALTVAVMFAASMFFSPLVSALSGIAAITSPALIIVGSLMMGSVSNMNWKEMDEAFPAFLVILAMPLTSSISTGIALGFISYPIVKAARGKWREIHPLVIVFAILFFIQLFIL

SEQ ID NO: 12821 - protein, 448 aa, Bacillus subtilis subsp. subtilis str. 168
MTHDLIEKSKKHLWLPFTQMKDYDENPLIIESGTGIKVKDINGKEYYDGFSSVWLNVHGHRKKELDDAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECRDQCLRELAQLLEEHHEEIAALSIESMVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELSEMVAIMKQAIHEVTSLED

SEQ ID NO: 12822 - protein, 463 aa, Bacillus subtilis subsp. subtilis str. 168
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 12823 - protein, 486 aa, Bacillus subtilis subsp. subtilis str. 168
MLTEQPNWLMQRAQLTPERIALIYEDQTVTFAELFAASKRMAEQLAAHSVRKGDTAAILLQNRAEMVYAVHACFLLGVKAVLLNTKLSTHERLFQLEDSGSGFLLTDSSFEKKEYEHIVQTIDVDELMKEAAEEIEIEAYMQMDATATLMYTSGTTGKPKGVQQTFGNHYFSAVSSALNLGITEQDRWLIALPLFHISGLSALFKSVIYGMTVVLHQRFSVSDVLHSINRHEVTMISAVQTMLASLLEETNRCPESIRCILLGGGPAPLPLLEECREKGFPVFQSYGMTETCSQIVTLSPEFSMEKLGSAGKPLFSCEIKIERDGQVCEPYEHGEIMVKGPNVMKSYFNRESANEASFQNGWLKTGDLGYLDNEGFLYVLDRRSDLIISGGENIYPAEVESVLLSHPAVAEAGVSGAEDKKWGKVPHAYLVLHKPVSAGELTDYCKERLAKYKIPAKFFVLDRLPRNASNKLLRNQLKDARKGELL

SEQ ID NO: 12824 - protein, 490 aa, Bacillus subtilis subsp. subtilis str. 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 12825 - protein, 451 aa, Bacillus subtilis subsp. subtilis str. 168
MTHVRLTTPKALTFFPTEHELTYLRDFVKTAHHNIHEKTGAGSDFLGWVDLPEHYDKEEFARIQKSAEKIQSDSDVLLVVGIGGSYLGARAAIEALNHAFYNTLPKAKRGNPQVIFIGNNISSSYMRDVMDLLEDVDFSINVISKSGTTTEPAIAFRIFRKLLEEKYGKEEAKARIYATTDKERGALKTLSNEEGFESFVIPDDVGGRYSVLTAVGLLPIAVSGVNIDDMMKGALDASKDFATSELEDNPAYQYAVVRNVLYNKGKTIEMLINYEPALQYFAEWWKQLFGESEGKDEKGIYPSSANYSTDLHSLGQYVQEGRRDLFETVLNVEKPKHELTIEEADNDLDGLNYLAGKTVDFVNKKAFQGTMLAHTDGNVPNLIVNIPELNAYTFGYLVYFFEKACAMSGYLLGVNPFDQPGVEAYKVNMFALLGKPGFEEKKAELEKRLED

SEQ ID NO: 12826 - protein, 490 aa, Bacillus subtilis subsp. subtilis str. 168
MLEYGFKDDSLSLHTDLYQINMAETYWRDGIHEKKAIFELFFRRLPFENGYAVFAGLEKAIEYLENFKFTDSDLSYLQDELGYHEDFIEYLRGLSFTGSLYSMKEGELVFNNEPIMRVEAPLVEAQLIETALLNIVNYQTLIATKAARIKGVIGDEVALEFGTRRAHEMDAAMWGARAALIGGFSATSNVRAGKRFNIPVSGTHAHALVQAYRDEYTAFKKYAETHKDCVFLVDTYDTLRSGMPNAIRVAKEFGDRINFIGIRLDSGDLAYLSKKARKMLDEAGFTDAKVIASSDLDEHTIMNLKAQGARIDVWGVGTKLITAYDQPALGAVYKLVAIEEDGKMVDTIKISSNPEKVTTPGRKKVYRIINQSNHHSEGDYIALYDEQVNDQKRLRMFHPVHTFISKFVTNFYAKDLHELIFEKGILCYQNPEISDIQQYVQDNLSLLWEEYKRISKPEEYPVDLSEDCWSNKMQRIHEVKSRIEEELEEE

SEQ ID NO: 12827 - protein, 326 aa, Bacillus subtilis subsp. subtilis str. 168
MENVFDYEDIQLIPAKCIVNSRSECDTSVRLGGHTFKLPVVPANMQTIIDEKLAISLAENGYFYVMHRFEPETRIDFIKDMNARGLFSSISVGVKDEEYEFVRQLAEENLTPEYVTIDIAHGHSNAVIEMIQHLKKHLPDSFVIAGNVGTPEAVRELENAGADATKVGIGPGKVCITKIKTGFGTGGWQLAALRWCAKAASKPIIADGGIRTHGDIAKSIRFGATMVMIGSLFAGHEESPGQTIEKDGKLYKEYFGSASEFPKGEKKNVEGKKMHVAHKGSIKDTLIEMEQDLQSSISYAGGTKLNAIRNVDYVIVKNSIFNGDKY

SEQ ID NO: 12828 - protein, 328 aa, Bacillus subtilis subsp. subtilis str. 168
MSQATAKVNREVQAFLQDLKGKTIDHVFFVACGGSSAIMYPSKYVFDRESKSINSDLYSANEFIQRNPVQLGEKSLVILCSHSGNTPETVKAAAFARGKGALTIAMTFKPESPLAQEAQYVAQYDWGDEALAINTNYGVLYQIVFGTLQVLENNTKFEQAIEGLDQLQAVYEKALKQEADNAKQFAKAHEKESIIYTMASGANYGVAYSYSICILMEMQWIHSHAIHAGEYFHGPFEIIDESVPFIILLGLDETRPLEERALTFSKKYGKKLTVLDAASYDFTAIDDSVKGYLAPLVLNRVLRSYADELAEERNHPLSHRRYMWKVEY

SEQ ID NO: 12829 - protein, 430 aa, Bacillus subtilis subsp. subtilis str. 168
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 12830 - protein, 511 aa, Bacillus subtilis subsp. subtilis str. 168
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 12831 - protein, 253 aa, Bacillus subtilis subsp. subtilis str. 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 12832 - protein, 394 aa, Bacillus subtilis subsp. subtilis str. 168
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 12833 - protein, 464 aa, Bacillus subtilis subsp. subtilis str. 168
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 12834 - protein, 447 aa, Bacillus subtilis subsp. subtilis str. 168
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 12835 - protein, 209 aa, Bacillus subtilis subsp. subtilis str. 168
MKQADELRFNEDGLIPAIVQDAASKEVLTLAYMNKESYEKTLETKETWFYSRSRQALWHKGETSGNTQAVKGIRYDCDQDALLVLVEPSGPACHTGSYSCFTKEQTEEQAADRFGIMNELERVIAERQAEMPEGAYTTYLFREGVDKILKKVGEEASEVIIAAKNRDHEELKWEAADLLYHLLVLLREQSLPLDDVLDVLKKRHSEIEE

SEQ ID NO: 12836 - protein, 457 aa, Bacillus subtilis subsp. subtilis str. 168
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 12837 - protein, 395 aa, Bacillus subtilis subsp. subtilis str. 168
MINRQHIQLSLQSLSLVAGFMVWVLISSLISQITLDIHLSKGEISLVTAIPVILGSLLRIPLGYLTNRFGARLMFMVSFILLLFPVFWISIADSLFDLIAGGFFLGIGGAVFSIGVTSLPKYYPKEKHGVVNGIYGAGNIGTAVTTFAAPVIAQAVGWKSTVQMYLILLAVFALLHVLFGDRHEKKVKVSVKTQIKAVYRNHVLWFLSLFYFITFGAFVAFTIYLPNFLVEHFGLNPADAGLRTAGFIAVSTLLRPAGGFLADKMSPLRILMFVFTGLTLSGIILSFSPTIGLYTFGSLTVAVCSGIGNGTVFKLVPFYFSKQAGIANGIVSAMGGLGGFFPPLILASVFQATGQYAIGFMALSEVALASFVLVIWMYWQERMKTHTERNSQSIN

SEQ ID NO: 12838 - protein, 290 aa, Bacillus subtilis subsp. subtilis str. 168
MRFDEAYSGKVFIASRPEWEEADAILYGMPMDWTVSYRPGSRFGPSRIREVSIGLEEYSPYLDRDLADLNFFDAGDIPLPFGNPQRSLDMIEEYVDSILEKGKFPMGMGGEHLVSWPVIKAMYKKYPDLAIIHFDAHTDLRVDYEGEPLSHSTPIRKAAELIGPHNVYSFGIRSGMKEEFEWAKENGMHISKFEVLEPLKEVLPKLAGRPVYVTIDIDVLDPAHAPGTGTVDAGGITSKELLASVHEIARSEVNVKGADLVEVAPVYDHSEQTANTASKIIREMLLGFVK

SEQ ID NO: 12839 - protein, 276 aa, Bacillus subtilis subsp. subtilis str. 168
MSELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 12840 - protein, 276 aa, Bacillus subtilis subsp. subtilis str. 168
MNVPFWTEEHVRATLPERDAESHKGTYGTALLLAGSDDMPGAALLAGLGAMRSGLGKLVIGTSENVIPLIVPVLPEATYWRDGWKKAADAQLEETYRAIAIGPGLPQTESVQQAVDHVLTADCPVILDAGALAKRTYPKREGPVILTPHPGEFFRMTGVPVNELQKKRAEYAKEWAAQLQTVIVLKGNQTVIAFPDGDCWLNPTGNGALAKGGTGDTLTGMILGMLCCHEDPKHAVLNAVYLHGACAELWTDEHSAHTLLAHELSDILPRVWKRFE

SEQ ID NO: 12841 - protein, 485 aa, Bacillus subtilis subsp. subtilis str. 168
MSFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 12842 - protein, 238 aa, Bacillus subtilis subsp. subtilis str. 168
MGKVLSSSKEAAKLIHDGDTLIAGGFGLCGIPEQLILSIRDQGVKDLTVVSNNCGVDDWGLGLLLANKQIKKMIASYVGENKIFERQFLSGELEVELVPQGTLAERIRAGGAGIPGFYTATGVGTSIAEGKEHKTFGGRTYVLERGITGDVAIVKAWKADTMGNLIFRKTARNFNPIAAMAGKITIAEAEEIVEAGELDPDHIHTPGIYVQHVVLGASQEKRIEKRTVQQASGKGEAK

SEQ ID NO: 12843 - protein, 461 aa, Bacillus subtilis subsp. subtilis str. 168
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 12844 - protein, 345 aa, Thermoplasma acidophilum DSM 1728
METVAVKLTGTKFFDTGLSTGTYFLFETAFASVTLALVSVVVLRKMKMSAFMLFSIIYFIFIWTIPAAWIWNPTGWLYKLGVRDFAGGLVVHVASGFAALAIMVRIWQEEKKMGLKESKKENLNLNSGWLTLSIILLWVGWFGFNPGSELAFTTETVIVVITTFLAAASAMVSTMLTKFLVSKQDPGLIYAVNGVLMGLIVITPLAGYVSPGSAIILGLISGPIFVSAESIFSKHKWYSDPIGVLPGHMVGGIFGLLMIAFFTQTPFADASGASNLPNGILFGGGIMALHQLGLEAMAVVVVGAFVFTVSYASVYAISLLLNGILRDSEYSPARPANRLAKDTGA

SEQ ID NO: 12845 - protein, 369 aa, Thermoplasma acidophilum DSM 1728
MNFEFDEAQKEFRKKVEEFARREFTEEAASKYDLQEKYPEEVVRRMISEGVFDYSNPWNILVATETFCKYDAGMGISMLVPFFGNEVIALFGNDDQKKKYLSKVFSGQAKMGLAVTEPGGGSDVANIKTTAVKEGDHYVLNGSKMFITNGDIADFFVLLARTSVEKKKHQGMSVFIVERNFDGFKSNKIHGKLGVRATDTAELTLENVKVPAENLVGEPGRGFYYIMTFFDISRAYVAAQALGIAEGILERAVGILQKDGPITSQPERVQFAIADMATRIEAAKLLTYEAASFIFNFNPNPAVTSMAKAYAAETAVYVSRKAMEITGIDGLSSNIERSFRDAKIMEIWEGTSEIEKLVIARMLKVGDSQ

SEQ ID NO: 12846 - protein, 247 aa, Thermoplasma acidophilum DSM 1728
MIEQSLEDALYAIVTQNPMIFLDYDGTLVPIIMNPEESYADAGLLSLISDLKERFDTYIVTGRSPEEISRFLPLDINMICYHGACSKINGQIVYNNGSDRFLGVFDRIYEDTRSWVSDFPGLRIYRKNLAVLYHLGLMGADMKPKLRSRIEEIARIFGVETYYGKMIIELRVPGVNKGSAIRSVRGERPAIIAGDDATDEAAFEANDDALTIKVGEGETHAKFHVADYIEMRKILKFIEMLGVQKKQ

SEQ ID NO: 12847 - protein, 183 aa, Thermoplasma acidophilum DSM 1728
MDEIINKYYEKCLPFSIPYGISQSGDPCQFFRNGLSFPDISAIFRKGTEMCDFRSQMDDAIRTRIKEIMPNTADLVGPKLAMDLLERSRGLRRLALMPASSIQMLGAEKALFQSLGQGKKNPKYGVIFKFPGLSALNPKARGRIARIIANKVAITARADLLGTHVDSRSMREDIEEKIRKVKK

SEQ ID NO: 12848 - protein, 349 aa, Gibberella fujikuroi
DPCSVTEYSGLATAVSSCTNIVLAGFQVPTGKQLDLSKLKAGTTVTFKGTTTFATTADNDFNPIVISGSGITITGASGHVIDGNGQAYWDGKGSNSNSNQKPDHFIVVQKTTGNSKITNLNIQNWPVHCFDITGSSQLTISGLILDNRAGDKPNAKSGSLPAAHNTDGFDISSSDHVTLDNNHVYNQDDCVAVTSGTNIVVSNMYCSGGHGLSIGSVGGKSDNVVDGVQFLSSQIVNSENGCRIKSNSGATGTINNVTYQNIALTNISTYGVDVQQDYLNGGPTGKPTNGVKISNIKFIKVTGTVASSAQDWFILCGDGSCSGFTFSGNAITGGGKTSSCNYPTNTCPS

SEQ ID NO: 12849 - protein, 468 aa, Agrobacterium tumefaciens str. C58
MLQQNCKWRAQIACLPPGQGFYGSMLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 12850 - protein, 489 aa, Agrobacterium tumefaciens str. C58
MRERSMIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 12851 - protein, 358 aa, Agrobacterium tumefaciens str. C58
MRPAMLQRRSMFLVRRRRPESLPSIEQEPEMKAMSLKSFGGPEAFDLVEVPKPLPKAGQVLVRVHATSINPLDYQVRRGDYRDLVPLPAITGHDVSGVVEATGPGVTMFAPGDEVWYTPQIFDGPGSYAEYHVANENIIGRKPSSLTHLEAASLSLVGGTAWEALVSRAALRVGESILIHGGAGGVGHVAIQVAKAIGAKVYTTVREENFEFARSVGADVVIDYRKEDYVAAIMRETEGLGVDVVFDTLGGETLSHSPKVLAQFGRVVSIVDIARPQNLIEAWGRNASYHFVFTRQNQGKLNELNVLVERGQLRPHVGAVYSLADLPLAHALLEKPNNGLRGKIAIAIDPQAETKVQS

SEQ ID NO: 12852 - protein, 389 aa, Agrobacterium tumefaciens str. C58
MSRITRPGMRNQPLEEKMTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 12853 - protein, 507 aa, Agrobacterium tumefaciens str. C58
METGMQTTAEAIKGKRLGLFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVIDYSGAMQDPFVIRLR

SEQ ID NO: 12854 - protein, 343 aa, Agrobacterium tumefaciens str. C58
MMKMKAVVMTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVFLPHGA

SEQ ID NO: 12855 - protein, 464 aa, Agrobacterium tumefaciens str. C58
MALWRSPSAIWPSTVEESPMSATTKEILDLNRFDASRTEGFPAELAERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLDIILQARRAA

SEQ ID NO: 12856 - protein, 310 aa, Agrobacterium tumefaciens str. C58
MRKLWKRPEMTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 12857 - protein, 435 aa, Agrobacterium tumefaciens str. C58
MSLNNEQSFWNQANRHLTRYGPSFESIIVERASGSYVYDANDRPILDFTSGQMSALLGHTHPDIVATVDRQMRSVAHLFSGMLSRPVVELASRLAALAPGLDRVQLLTTGAESNEAAIRMAKLVTGGHEVVAFAQSWHGMTGAAAAATYSAGRRGYGPVAAGSLVIPAPNSYRPRFAKPDGTNDWQTELDDAFALIDNQSTGSLAAFIAEPILSSGGILELPAGYLAALKLKCEERGMLLILDEAQTGVGRTGHMFAFQRDGVTPDILTLSKTLGAGLPLAAVMTTEAIEQKAFEKGYLFYTTHVSDPLLAAVGVTVLDVVEREGLLAAAIGRGARLRAGLVSLQQRFECVGDVRGRGLLMGLEIVADRQTKAPGFALGAKIMEEAMRRGLSMNIVKLPGMGGVFRIAPPLTVSDEEIDHGIEIMSDSIQAASGA

SEQ ID NO: 12858 - protein, 353 aa, Agrobacterium tumefaciens str. C58
MTLSSGCEYRLSEAMMIEMMKAVRLHEFGGPEVLSYEEAPRPVAASGEVLVRVHAAGINPPDLYLRDGYRTLPPEWQPEPTFPLILGTDVSGVVAAIGDGVSAFSVGDEVFAMVRFPEDLMQGSGAYAEYVTVPASELALKPAGIDHIQAAGAPMSLLTAWQFLVDLGHDAPNPFQSFRHSPIPLQGKTVLVNGAGGGVGHLAIQLAKWRGAHVIAVASGKHEALLRALGADQIIDYTKTAAETAAEDVDLVIDAVGGSNMERFLNVVRPGGALFLVNPLGFSAHKDAARCGITVSSTQVRSNGAQLAEAGRLLNDGSIRVVIDSTSPLAEAAAAHERASGGGIQGKIVLFAG

SEQ ID NO: 12859 - protein, 228 aa, Agrobacterium tumefaciens str. C58
MGRKLLAEFFGTFWLVFGGCGSAVFAAAFPELGIGFTGVALAFGLTVLTMAYAVGGISGGHFNPAVSVGLTVAGRFPASSLVPYVIAQVAGAIVAAAALYVIATGKAGIDLGGFASNGYGEHSPGGYSLVSALLIEIILTAFFLIVILGSTHGRVPAGFAPIAIGLALTLIHLISIPVTNTSVNPARSTGQALFVGGWALQQLWLFWLAPIVGGAAGAVIWKLFGEKD

SEQ ID NO: 12860 - protein, 461 aa, Agrobacterium tumefaciens str. C58
MNIMQPLRADATAVADPQADISARLERLPITREVFWARNIVGAATFFDGYTVIAIAYAMPVLVREWGLTPSQTGMILSMGYLGQLIGAILFGWLAERIGRLKVLLFTILLFVSMDVACLFAAGAGMMMAFRFVQGIGTGGEVPVASAYINELIGSKGRGRFFLLYEVMFLLGLVGAGLIGYFMVPLYGWKAMFIVGLVPAMLMIPLRWFLKESPRWLAATGRYDEANVIVKRMEESARAAGKALPEPRIIATPAKRVSDWRELFQGIYLKRTLSIWAMWFCAYMVANGTITWLPTLYRQTFNLPLETSILYGFMTSAAGVVAAVICALLIDKVGRKRWYAGALLLAPVPLAILAWLGATSPMQVLIFAGLAYAIVQTVTFSLYLYSAEIYPTRMRAIGTGAGSAWLRLGSSAGPMLVGFVMSSMGIQYVFATFAFILIIGAVVTMLFAVETKGKVLEELSP

SEQ ID NO: 12861 - protein, 364 aa, Agrobacterium tumefaciens str. C58
MTDKTLFEPYALGAISLSNRIVMAPLTRNRAGAGFVPGDLTAEYYTQRASAGLIISEATQISQQGQGYQDTPGIYTRAQIDGWRKVTAAVHEKGGRIVLQLWHVGRISHIDLQPNGGQPVAPSAIRAATKTFVNNAFVDVSEPRALEIEELAGIVNDFRKAAANAIDAGFDGVEIHGANGYLLEQFAKDGANVRTDAYGGSVENRARLMLEVTAAVAQEIGPARTGIRISPVSPANGISCSDAQAQYDYIVDQLDALGVAYIHVVEGATGGPRDVAPFDYGSLRRRFSKTYIANNGYDLELAATHIAEGKADLIAFGRPFIANPDLVKRLQSGAPLAEIDPATIYGGGAEGYTDYPRFNEASGS

SEQ ID NO: 12862 - protein, 359 aa, Agrobacterium tumefaciens str. C58
MPSLCRKPWLSSLPDLINVSHWRKPVKAFVVDKYKKKGPLRLADMPNPVIGANDVLVRIHATAINLLDSKVRDGEFKLFLPYRPPFILGHDLAGTVIRVGANVRQFKTGDEVFARPRDHRVGTFAEMIAVDAADLALKPTSLSMEQAASIPLVGLTAWQALIEVGKVKSGQKVFIQAGSGGVGTFAIQLAKHLGATVATTTSAANAELVKSLGADVVIDYKTQDFEQVLSGYDLVLNSQDAKTLEKSLNVLRPGGKLISISGPPDVAFARSLKLNPLLRFVVRMLSRGVLKKASRRGVDYSFLFMRAEGQQLHEIAELIDAGTIRPVVDKVFQFAQTPDALAYVETGRARGKVVVTYAS

SEQ ID NO: 12863 - protein, 453 aa, Agrobacterium tumefaciens str. C58
MKEYDAIFIGAGQAGPFLAARMAAMGRKVVLIERKFLGGTCVNAGCMPTKTLVASAKTAQVARRASEFGVRIDGEPVVDMKAVAARARKVTLDARSGLASWFDSLETMDVVYGHARFVGAKVVSVGGSLYTAPQIFINVGARPHIPDVPGLANVPYLTSTSVIALEELPKHLVVLGGSYIGLEFAQMYRRFDAQVTVIERGQYLASREDEDISQAIADILTRDGIKVLLSHKIVSVTTDSAEITVRTDQGDVRGSHVLVAVGRQPNTDDLGLDQAGVETDRRGYITVDERLQTNVEGIWALGDCNGRGAFTHTSYNDFEIAAANLLDGGDRKVSDRILGYGLYIDPPLGRVGMTERQAKEAGHRIKVATRPMNRVGRAVEKGETLGLMKLVTEADTDRVLGAAFLGVGGDEAVYGVLDAMNLGATTEKLRWAVPIHPTVGELVPTLISDLKET

SEQ ID NO: 12864 - protein, 421 aa, Halobacterium sp. NRC-1
MAVTHAEGIEVTDAGGTTYLDCLAGAGTLALGHNHPAVTAELERLLAEDRPLHTLDITTPEKEAFVDALFDSLPASFANTAKVQFCSPAGTDAIEAALKLTKTATGNRSVLAFHGGYHGMTAGALSLMGDIDAKEPVSGLMPNVHHLPYPDQYRHPFGLPAGEHESIHTYIEHAISSPERGFTEPAAVVLELVQGEGGVNPAPDAWVQELRRITREHDIPLVVDEIQTGLGRTGETWSFEHAGIEPDVVTCSKAVGGGLPLAVVLYNEGLDVWEPGAHAGTFRGNQLAMAAGRVTIEHVIEQDLPAHADKTGARLRSALTDLEADFDVVGDVRGRGLMLGVEFVAPDAAGDERPPPDGDLAAAVKQACFERGLIIETGGRDSAVARFLPPLIVSSHQIDEIAARFSDAVTAVLSSSAEVSA

SEQ ID NO: 12865 - protein, 487 aa, Halobacterium sp. NRC-1
MSSSQTRSPDAELGLLDATMIGMGAMIGAGIFVLTGLAAEIAGPAAILVFALNGVVTAFTGLSYAELAASIPKSGGGYAFVREIFGDFSSFIMGWMLWFAYMIAGALYALGFAPNFLELLHVYGLVAPPDQVGAIAVPLLDASVPAAFVLAFIAVLGLVALNAVSTAASGSAETIFTIIKVSILVVFVAFGATSPLFSGAEFQPLFGVGGGPAAILPAMGLTFIAFEGYDLITTVTEEVKNPRENIPKAIFVSLIATVIVYLAVVTVAVGTLGADGLAAAGEAGIAEAATSFMPTGLPIIQNGGALIVFGAVFSTLTALNAVVIASSRVAFSMGREGQLLPSFGQIHHRYGTPFVAIIASAVVMLASVALPTQSAGNMSSLFFLLSFIIVNVAVIRLRRERPDMNRPYEMPFYPAPPLIGIALNLVLSVVLVDYLVRTDPLALALSAAWIVLGTAAYYAHASRQSAAGDDEDTTTISADAEHTPHDH

SEQ ID NO: 12866 - protein, 1037 aa, Caulobacter crescentus CB15
MEVRPGPFLTWNERFFSRVPPGGSTSERMSDENENGRPGGRTPMTLKPRQGSVSAGVVKQSFSHGRTKTVVVETKRTRTHAPASGNLAAPSSAERRHGEAPAPRPAPPQGGGGGSAGGLSQEELRARQRVVDAAREAQARQVAEQAAAEARARAAQEAAQREAAAKAAAERAAAAPPPVAQAPAAPAPAAPVTPPPAAPQAPRPVAQAPVAPSAPRQDAPRQDTRAAAPGQTRTYEPSRDRRDDRPSTTTYRPAPQGDRPFNQRAPRPDANANFGQRAPRPEGDRPRGPRPDGDRPQGDRGGYRGDRPQGDRPQGDRPQQTVRYSALAPRPAPGARGPGGPPRGPRPGVPAAAPATPEIQRATRSAPRPGGGAMDRRPDEDDDRRKNAAPNKAVSRVKGAPQRREGRLTIQAVAGDGDSADRMRSLASVRRAREREKEKRRGGAVEQARVAREVVIPDVITVQELSNRMAVRGVDIIKFLMRQGVMLKINDVIDNDTAELVATEFGHTVKRVSEADVEEGFIGADDHDEHMDLRPPVVTIMGHVDHGKTSLLDALRSTDVAAGEAGGITQHIGAYQVRLKDGQRVTFLDTPGHAAFSSMRARGANITDIVVLVVAGDDGVMPQTIEAIKHAKAAEVPIIVAVNKMDKPGSDPTRVVNELLQHEIVVESLGGDTQLIEVSAKARTGLDNLLEAILLQAEVLDLKANPDRSADGVVIEAKLDKGRGAVSTVLVNRGTLKRGDIVVAGSQWGKVRALLNERNEQLQEAGPATPVEILGLDGVPSPGDAFAVVENEARARELTEYRIRLKREKSMAPVGAGASMADMMAKLQDKKLKELPLVIKADVQGSAEAIIGSLDKMATDEVRARIILSGAGAISESDVMLAKGAGAPVIGFNVRASAQARALAEREGVEIRYYAIIYDLLDDIKGVLSGMLAPIQRETFLGNAEVLQAFDISKIGKVAGCKVTEGVVRKGAKVRIIRQDIVVLELGTLQTLKRFKDEVNEVPVGQECGMMFAGFQDIKVGDTIECFTVEEIKRQLD

SEQ ID NO: 12867 - protein, 226 aa, Caulobacter crescentus CB15
MARYPRAMTAPIIAPSILASDFAKLGEEVAAIEAAGADWVHVDVMDGHFVPNITLGPDIVKAIRPHAKIPFDVHLMISPADPYLEAFRAAGADLISIHPEAGPHLHRSLKRIRELGAKAGVVFNPSTGIDHVEWILEDVDLLLVMSVNPGFGGQSFIPGQLRKVEALRKMVDKAGLDIIIEVDGGVTPVTAPQCVAAGATALVAGSAVFKGGPAAYADNIRALKGG

SEQ ID NO: 12868 - protein, 438 aa, Caulobacter crescentus CB15
MIEKTFKLSAQGTTVRTEVLAGVTTFLTMAYIVIVNPAILGQAGMPIAAVAAATCLAAGLGSILMGLIANYPIALAPGMGLNAYFTFTVVKGMGLPWETALGCVFLSGVAFLILTVAGIRQLIVGAIPRPLFSAVAAGVGLFIAFIGLKEAGIIVADPATTVALGDLTKPTAVLAILGLLVMGALMAWRVKGAILIGILVAAGVAWALGLAKIAPGDYGLAALTATAFKLDVPAALHLNGAFGMALAEVIFVFLFVDLFDNVGTLVAVTKKAGLVQPDGSIPRLNRILTADSIATIGGSLAGTSTVVSYIESASGVAEGGRTGLTAVVVGLLFLLTLFFAPWVQAIPVAATAPALIVVGAMMVGALADVDWDDPGVAIPAFLTVIAIPLTFSIANGLAFGITAYAGLTLLRGKAKPKDWLLFVLAGLFVLRFIYMGKA

SEQ ID NO: 12869 - protein, 236 aa, Caulobacter crescentus CB15
MVDKVKKDAVEALAGLLFDGMTIMAGGFGLCGIPENLIAAIREAGTKDLTVISNNCGVDGFGLGILLENRQIKKMVSSYVGENKLFEQLYLSGELELEFNPQGTLAERIRAGGAGIPAFFTRTGYGTLVAEGKETREFDGEMYVMERGLTADLSIVKAWKADAEGNLIYRKTARNFNPMMATAGKKTVVEVEELVAIGELDKDAIHTPGIYVDRLIKGAKFEKRIERVTTRQKETA

SEQ ID NO: 12870 - protein, 306 aa, Caulobacter crescentus CB15
MKALSIPDVLAEVAVLVRPHFGKGKPADYIPQLATVPGGKFGMAVRMVDGDEHVIGDADEGFSVQSITKVFALGLALNRLGDEIWTRVGKEPSGTPFNHLSLLEAEQGVPRNPFINAGALAVTDVLMDVTRDPAALVRDFGGFLCGERLEIDPAVATSELAHAWQNRAIASLMRAKGTITHDPEAVVAAYCRQCALSMSCRQLARAFLPLAAGGFSPIAQETVFPERLTRRLNALLLTCGIYDSVGSFAYRVGLPAKSGVGGGIVAVVPGKATVAVWSPELDRFGTSVVGTAALEAFSQITNCSVL

SEQ ID NO: 12871 - protein, 475 aa, Caulobacter crescentus CB15
MARPEGDRPMAQYDVVIIGGGPGGYNAAIRAGQLGLKVAIVEGRGKLGGTCLNVGCMPSKALLHASELYAAATGPEFAKLGIEVKPKLNLSQMMAQKAESVEALTKGVEFLMKKNKVEYVKGWGRIDGVGKVVVKAEDGSETTLETKNIVIATGSEPTPLPGVSVDNKRIIDSTGALSLPEVPKRLVVVGAGVIGLELGSVWKRLGAEVTVVEYLDRILPGTDTEVANAFQKILVKQGFKFQLGAKVTGAEAGAKGVKLSFEPVAGGEAQTIEADYVLVAIGRRPYTQGLGLETVGVTPDKRGMIANDHFKTGVAGVWVIGDVTSGPMLAHKAEDEGVACIEMIAGKAGHVNYGIIPGVVYTSPEVATVGKTEDELKAEGVAYKVGKFPFLANSRAKINHETDGFVKILADAKTDRILGAHMIGPNVGDMIAEYCVAMEFGGASEDVARTCHPHPTRSEALRQAAMGVEGWTMQA

SEQ ID NO: 12872 - protein, 323 aa, Caulobacter crescentus CB15
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 12873 - protein, 479 aa, Caulobacter crescentus CB15
MREYTKFYIDGAWVDPAAPNTLDVINPATEEVCGVISMGSEADVDKAVRAARKAFASFSQTSREERIDILERIIAEYQKRFEDMAKAITEEMGAPAWLAQRAQAAMGIGHVQTAAAVLKGYKFEEDRGTTRIVKEPIGVCAFITPWNWPVNQIACKVGPAIATGCTMVLKPSEIAPFSGYIWTEIMHAAGVPAGVFNLVNGDGPTVGAALSRHPEVDMVSFTGSTRAGIEVAKNAAPTVKRVHQELGGKSPNIILDDADFSRAVAGGVASVMMNSGQSCNAPTRMLVPGARMDEVIAIAKAAAESHTVGDPNGNHKMGPVVSETQWNKIQGLIQKGIDEGATLVTGGVGRPEGLDKGYYVKPTVFANVTNEMTIAKEEIFGPVVSILGYDTVDEAVTVGNDTEYGLAAYVSGGDQDEVRKVASRLRAGQVTLNGAGPDLMAPFGGYKMSGNGREWGDHAFGEFLETKAILGYSAKVAAE

SEQ ID NO: 12874 - protein, 139 aa, Caulobacter crescentus CB15
MSTDLFPQAHSKHDLERGFALAPRFNADGLVVAVAQHADTGEILMLAWMNAEALKLTVETQIAHYFSRSRNELWKKGDTSGQLQDVVELRVDCDQDAVLLKVRPRGDGGACHVGFRSCFYRVLENGVLVEREAPLHDHA

SEQ ID NO: 12875 - protein, 392 aa, Caulobacter crescentus CB15
MSALMNTYARANIDIVRGEGCWLYDQDGRDYLDLAAGVAVNTLGHGDPRLVQALKTQADILWHASNLYRLPAQEALATKLTDATFADRVFFANSGAEAVEAAIKTARRWQGAKGRPERYRVLTFGNAFHGRTLATISATDQMKVREGFTPLYDAFDTTPFNDIEGAARAITPQTAAILVEPIQGEGGLTPATPGFLAGLRALCDQHDLLLILDEVQTGIGRTGHLFAHELYGVRPDIIAVAKGLGGGFPIGACLATEDAASGMTPGSHGSTYGGNPLACAVASAVLDAVLAPGFLETVRERAALVDALLERLLRRHSDLFVRAQGHGLMRGLQVRASARDVVAHLRDFGVMTVAAGADVVRLLPPLTISELEIAEAEARLLRAAEAWLPIAA

SEQ ID NO: 12876 - protein, 125 aa, Caulobacter crescentus CB15
MGAMRILLVEDDEAIRDLVTGVLEGAGYEVSTAADGQAALDMLPGVAPHAMVVDINMPGMDGLALLHAVRRDPAFAEIPALMLTAQTSPEDIRRSMSLGAADFIGKPFEARVLLRRLERMVRSAS

SEQ ID NO: 12877 - protein, 473 aa, Caulobacter crescentus CB15
MLSKRARLQSLRAARRRAGDSDPPPRSTRIKATEQRRSRLPEDRSDAVSRPRRRRLALADTQTIEAIMLSREFLKAGHAPTLFAAFLYFDLSFMVWVILGPLGVAIAKDFNLDPAQKGLMVAVPVLAGAVLRLVNGVLVDRIGPKKTGIIGQLIVLAGLVTAWAVGLHNYQQILALGLVLGVAGASFAVALPLASRWYPQEHQGLALGIAGAGNSGTALAALFAPALAKTFGWQNVIGLAAIPLAFAFVAYLVLAKDAPEQPAPKKLAEYLDVLKVPDAWWLMLLYGVTFGGFVGLASSLTMYFNSEYGLDPVIAGFFTAACVFAGSFIRPVGGALADRYGGVRTLGVVYVLAAIGLTVAGFQLPSAGLALAVLLFAMLALGAGNGAVFQLAPQRFRNEIGVMTGLIGMTGGIGGFYLASTLGLAKKMTGSYQSGFIGFALLAVFALIALFSLKARWRAVWPTLHGDAAPVRV

SEQ ID NO: 12878 - protein, 1029 aa, Caulobacter crescentus CB15
MTDWDSLDAGKYRDEAAVIADLLAAKPLSSEDRAAVRAEAEALVRGARRSVRKQGVVESFLQEFSLGTREGLALMCLAEALLRTPDDDTRDKLIAEKIGSADWASHLGGSDSLFVNASTWGLMLTGKIVEPDETARNDMPGFIKKLAGRLGEPVIRAAVGQAIRIMGEQFVLGRTIEAAIKRAAAEGDMCSFDMLGEGARTAADAARYEKAYADAIETVGKLSNGAGPEAGHGVSVKLSALCPRYEATHEDRVWEELYPRTLRLAKIAARHNLNFTIDAEEADRLALSLKLLDKLCREPELGDWTGLGLAVQAYQKRCGEVIARLKALSEETGRRLMVRLVKGAYWDSEIKRAQVAGRPDYPVFTTKPATDLSYLVNAKALIEAAPHLYAQFATHNAHTLAAVVRMAKNTGVKIEHQRLHGMGEALYKAADDLYDGITLRAYAPVGGHEDLLPYLVRRLLENGANTSFVHALLDERVPVEKVVTDPIDTVEAHPDRHAKIPTPINVYGERRVNSAGLDLSVKADRERLSAAVAAQDGVTLSAGPLVGGKVVAGGAPLPLIAPANDQKTVGVVSEAQSAQIDEAFKLARAAQPAWDRAGGVARAQVLRAMGDALEANIERLIALLSREAGKTLSDGIAEVREAVDFCRYYAMLAEDQFGEAEILKGPVGETNSLRLAGRGVFVCISPWNFPLAIFTGQIAAALAAGNAVLAKPAEQTPLIAFEAVKLYHAAGLDPRLLALLPGRGETVGAALTSHEDLDGVAFTGGTDTAWRINQTLAARQGPIVPFIAETGGLNGMFVDTTAQREQVIDDVIVSAFGSAGQRCSALRLLFLPHDTADHIIEGLKGAMDALVLGDPALAVTDVGPVIDAEAKDALDKHLVRLKSDAKVLHALAAPAGGTFFAPVLAEIPTADFLEREVFGPVLHVVRYKPENLEKVAGALAARRYGLTLGIHSRIESFAADVQRLVPAGNAYVNRSMTGAVVGVQPFGGEGLSGTGPKAGGPHALLRFAVERALSVNITAQGGDPALLNL

SEQ ID NO: 12879 - protein, 478 aa, Caulobacter crescentus CB15
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 12880 - protein, 512 aa, Caulobacter crescentus CB15
MHPYLHAQSQGDKAAYIMAGSGEVVTYAQLDARSNQGAHLFRSLGLVPGDVIAILMENNARFFEVAWAAQRSGLYFVCISTKLTASEAEYILQDCGAKVFITSTAMGPMIDEIAALVPGLSLFTVGGAHGPYADFVAAREGRPTTPIADESAGTDMLYSSGTTGRPKGVKPALSGGPIDAPNALQMMAQGLFGFSGDSIYLSPAPLYHAAPLRWCMTVHKLGGTVIVMEKFEPETALALIEQHRVNCGQFVPTHFVRMLKLPEAVRAKYDVSSMKSAVHAAAPCPIPVKEQMIAWWGPVIFEYYAGTEGNGFCWINSQNWLTHKGSVGQAVLGELRICDEAGDPVPPRTEGTVYFANGPAVNYHNAPDKTAESYNKHGWTTLGDVGWADEDGFLYLTDRKSFMIISGGVNIYPQEIENLLITHPKVADAAVVGAPHEEMGEQVVAVIQPMDLGDDQVALAEELMAFARANLSHVKSPRRIDFMAELPRHPTGKLYKRLIRDAYWGKGESKIV

SEQ ID NO: 12881 - protein, 468 aa, Caulobacter crescentus CB15
MISRRGALIAGGTGAAVVAGGAGAAYMVATGDKPEPPAPASVNAQGKVLWRNWSGVQHAYPAARLAPKDEGELATALKVAQAPIRPVGSGHSFTALAPTDGTLVSLDSMSGIVGWEGDEAIVRAGTRLGALGPLLAEKGRALANLPDINKQSLGGALGTATHGTGIKIPAMHGDVTGLRLVTPSGKIIDADASNNPEIFQAARVSMGALGVISQVRMRTSANRRLRRRVWLEPFEEAMAKADGRWAQHRNFEFYAVPFTGLAVNITHDETDDPAEARGPDQDVEFLQALRGLRNLLGFATPLRKAAAKALLSSAKPESSVDEGWKLLSTERPVRFNEMEFHLPVENQLKALEEVMRTIETERPDVFFPIEVRRIAADDAWLSPFYAAPRGSVAVHAYYRDDFTFLYELIEPIFRRYEGRPHWGKLHTLRGRQLEAIYPRWKDFLEVRQDLDPEARMLNPYLKGLFGLM

SEQ ID NO: 12882 - protein, 191 aa, Caulobacter crescentus CB15 [sequence omitted]

SEQ ID NO: 12883 - protein, 298 aa, Caulobacter crescentus CB15
MTRIAFIGLGNMGGGMAANQAKAQHQVRAFDLSAAAVERAVAAGCLAAASVAEAVAEAEIVITMLPAGPHVRAVYAEQILPNAPKSALLIDCSTIDVDSARVVARQAAEAGFRFADAPVSGGIMAAEAGTLAFMVGCEASDFAAVEAALAPMSRVTIHAGDHGAGQAAKICNNMLLGVSMLGTCEAFALAEKLGLAADRFFEIASKSSGQCWSITSYCPVPGVGPQTPADRGYEGGFASAMMLKDLKLAQEAAAKAGASTPMGAQAEALYALFDANGFGGKDFSAVIELLRGRVADLH

SEQ ID NO: 12884 - protein, 406 aa, Caulobacter crescentus CB15
MSTDFHRIRRLPPYVFEEVNKIKARLRAEGTDIIDFGMGNPDMPTPQHIVDKLIETARDPKAGRYSASKGVPGLRKAMANYYGRRFGVKLNPDTEVIATLGSKEGFANLAQALTGPGDVIICPNPAYPIHAFGFIMAGGIIRHVPALSPEEYLSNISRAVKHSVPPPSVLILSYPSNPTAQWVDLDFYKDAVALAKKHDLLVISDVAYGEIYFDNNPPPSILQVDGAKDIAVEVNSLSKTYAMAGWRVGMVVGNARICAALARVKSYLDYGAYTPVQVAAATALNGPQDCVDEIRGIYKSRRDTLIKSMKAAGWDIPNPPASMFAWAKIPEAYREAGSMLFSRLLIEEAGVAVAPGIGFGEYGEGYVRIGLVENEHRIRQAARNVKKFIANADSILAKAHNKMEQA

SEQ ID NO: 12885 - protein, 386 aa, Caulobacter crescentus CB15
MDEETRLIHTGSEPARLGRTVNPPIQRGSTVLLPDAASLYDDDQLTYGITGLSTPVALQNALAELEGATNVTLYPSGLAAITGAMLAVLKAGDEVLVVDSAYKPTRRFCDRVLGRFGVTTRYYDPKLSPEALMGLVTSSTRLIVLEAPGSLTFEMQDIPAIAAAANARGVLTLIDNTWAAGLLFKPLAHGVTMSVQALTKYVGGHSDCFMGSVATCDDAVAKLLGDAMWDIGWSVSSDDAYTMLRGLRTLATRLPRHAENGLAIARWLQERPEVARVLHPALPGDAGHAIWKRDFTGACGLFGVVLKPCSQKAVHAFLDSLKLFGLGFSWGGYESLALNCDPQLGARSIPVDLEGPLLRFHIGLEGIEDLKADLRRGFEALNAAKA

SEQ ID NO: 12886 - protein, 332 aa, Caulobacter crescentus CB15
MSALPSVLDAIGNTPLIRLARASEATGCEILGKAEFMNPGQSVKDRAALAIIRDAEAKGLLRPGGRIVEGTAGNTGIGLAMVASALGYKTTIVIPRTQSQEKKDAIRLLGAELVEVDAVPYSNPDNYVRYSGRLAEELARTEPHGVIWANQFDNTANRDAHYHTTGPEIFDQTSGKVDGFICAVGSGGTLAGVAAALRERKPGVRIGLADPYGAALYAWYKDGELKSEGSSISEGIGQGRITANLEGLAIDDPFRVSDQEMLEVLYDLVQHEGLCLGGSAGINVAGAIKLATAMGPGHTIVTVLCDHGSRYQSKLFNPVFLKEKGLPTPPWM

SEQ ID NO: 12887 - protein, 246 aa, Caulobacter crescentus CB15
MSAIDAKSLKKSFGDTPVLAGVDLAVVPGEVVAIIGPSGSGKSTLLRCLAGLEPLNDGDLTIAGVAAGGKTPLAKALNGRVGFVFQSFNLFPHRTALENVIEGPIVVRREDPAKARAKGLALLEKVGLADRVDAYPSALSGGQQQRCAIARALAMDPEVILFDEPTSALDPELVGEVLAVIRDLAAEKRTMVIVTHQMDFARDVAERTIFMDGGVIVEQGPSRQLLASPREERTRRFLARSGVLQP

SEQ ID NO: 12888 - protein, 320 aa, Caulobacter crescentus CB15
MKAAVYYETGAPDVLRYEDAADPVCHAQGVVIRVEAVSIEGGDTLNRGGGQMAGVPHIVGYQAAGEIIEVGAEVSHLKVGQKVVTVNAFGSHAELRSVPARNAWPIPEGFDLHKAAAIPVPFGTAHECLFGAGRLKAGETVLVQAGAGAVGLAAIQLAKQAGATVLASASSDERLERLKPFGMDHGINYRRDDLVEQVMKLTGGKGVDLVVDPVGGATLPGSLAALGYRGRVSLVGNAGREPMKVDVGSLMGGNRSLTGVFLGAEIMTDRVHDMIQDLIEKAARGELEVVIDRTFPLSQAAAAHAYIESRQAVGRVLLIP

SEQ ID NO: 12889 - protein, 286 aa, Caulobacter crescentus CB15
MKTAFIGMGVMGFPMAGHLKAAGHEVAVYNRSPEKARRWAEKHGGAAFETIAEAVAGAEVVLLCVGNDDDVRDLVAQVLPAMGEGGVIVDHTTTSAKVAREMAALAAQSGRAFVDAPVSGGQAGAESGQLTIMAGGDQAAYDRVLPVIEVYAKAVRRIGEVGAGQLTKMCNQIAIAGVVQGVAEALHFAKRACLPTDDVLAAISKGAAQSWQMENRWPTMAQGKFDFGFAVDWMRKDLGIALDEARTNGAKLPATALIDQFYAEVQAMGGNRWDTSSLVARLEKDG

SEQ ID NO: 12890 - protein, 359 aa, Caulobacter crescentus CB15
MRSLSRTCVAAADTERTTEPMTIAIRSVEKQFGRYPALNKVDLEIADGELLALLGPSGSGKTTLLRTIAGLEFPDAGQVLFDGQDVTYASAAARRVGFVFQQYALFKHMTVAKNIAFGLDVRKGKDKPSKAEIARRVEELLKLVELEGLGGRYPSQLSGGQRQRVALSRALAVQPSVLLLDEPFGALDATVRKSLRRELRRVHDATGVTTIFVTHDQEEALELADRVAILNNGRIEQIGTPDQVHDAPETAFVCGFVGEANRFDGQVSGGRFKAGALTVPASALKDGAATAYVRPHDFALDEAGFEVLIERAQVQGALTAVTALTSDGRRLEISASRADADRFTGAVKIVARKAHVYAA

SEQ ID NO: 12891 - protein, 487 aa, Caulobacter crescentus CB15
MEIREGLTFDDVLLEPAASDVMPTQVTTETRFTREISLNIPLVSAAMDTVTESRLAIAMAQAGGMGVLHRNLSNEEQADQVREVKRYESGMVINPLTIHPDTTLAEIREIKARRKISGFPVVERGSGKLVGILTNRDMRFEGDDKVPASQLMTRDNLITVSEGVDHREARELLRRHKIERLIVVDEAYRAVGLITVKDIEKAQAHPLAAKDDKGRLLVGAASTVGDAGFERSMALVDAGVDVVVIDTAHGHSSQVAAAVTRLKREANRVQIVAGNIATYDAARALIDAGADAVKVGIGPGSICTTRIVAGVGVPQLTAIMEAVRAAKESNTPVIADGGIKYSGDLAKAIAAGASTAMMGSMFAGTEEAPGEVFLYQGRSYKSYRGMGSVGAMARGSADRYFQKEVTDNFKLVPEGIEGQTPFKGPISPVLHQLVGGLRAAMGYLGAPTIPELQKRARFVRITGAGLRESHVHDVMITREAPNYPSAV

SEQ ID NO: 12892 - protein, 460 aa, Caulobacter crescentus CB15
MARDGAVYACQSCGAVQTKWSGQCSACQSWNTLVEEVSAKPPGALSATKATRVRGLQFTGLESETAPPPRILTGVDEFDRVCGGGVVPGSALLIGGDPGVGKSTLLLQVCASAAARGVSCAYISGEEAVEQIRGRADRMGLAKANVSLAAETALRDILDGLKRDNFDLVVIDSIQTMWSDAHEAGPGTVTQVRACATELVRLAKKKGVAILLVGHVTKDGQIAGPRVVEHLVDAVLSFEGERGYPFRILRGAKNRFGATDEIGVFEMGDVGLREVKNPSALFLNEGGERAAGAAVFAGIEGSRPVLVEFQALVAPSAYGTPRRAVVGWDSGRLAMVLAVLEARCGLGFGDKDVYLNVAGGLRITEPAADLAAAAALASSALDVALPQDCVVFGELSLSGEVRPVSRMETRLKEAAKLGFGRALGPLAGLPEGGGALPVAGVARLTDAVRRIGDEIWTSLT

SEQ ID NO: 12893 - protein, 426 aa, Caulobacter crescentus CB15 [sequence omitted]

SEQ ID NO: 12894 - protein, 160 aa, Caulobacter crescentus CB15
MAMSIYDYSAKTLDGQDVSLADYRGQVLLIVNTASKCGFTPQYEGLEALYKAHKDRGFTVLAFPCNQFGAQEPGNAEEIANFCSLTYDVSFPVMSKIDVNGADAHPLYKFLKKEQKGVLGTEAIKWNFTKFLIGKDGQVVDRFAPTVKPEDLKVAVEALL

SEQ ID NO: 12895 - protein, 466 aa, Caulobacter crescentus CB15
MSTEFDVVVIGAGPGGYVAAIRASQLGLNTAIIERENLGGICLNWGCIPTKALLKSGEVYEQLSHLGGYGLSVEKASFDFGKIIERSRGVAKNMSGGIAFLMKKHKIEVIEGEAKLEKGAPAPKVVVALKAGGSRTVQAKNVILASGARAREIPAIGAVSDGDKIWTYRDALAPKSMPKSLVVIGSGAIGIEFASFYRALGAEVTVVEAIDRIMPVEDEEVSKAAQKAFEKRGIKFRVGAKVSKIEKTKDGVAVTVEAGGKIEQLTAEKCIVAVGIAPNNDGLEALGVSLDRGHVVTDKHCRTNVPGLYAIGDIAGAPWLAHKASHEGIHAAEAIAGYKTPNVLSPIPGCTYANPQVASVGYTEAGAKAAGIEVKAGRFPFRVNGKAVASGETEGFVKTVFDAKTGALIGAHMIGHEVTEMIQGFVTAITLEATEEDLHGVVYAHPTMSEAMHEAALDAYGRVLHI

SEQ ID NO: 12896 - protein, 430 aa, Caulobacter crescentus CB15
MGRRDGRRAGPYERPINHVGDARGSIANFGARVDRPRLVVATSWLPARSATPRDAPFASGDSVVSTSSLFAPTTVAGLALRNRVVMSPMTRRFSPGGVPNQAVADYYRRRAEAGVGVIITEGVAVDHPAAVDHADIPNFHGPALDQWKTIAASVTSAGAAFIPQLWHIGGHRSLTADPPNASAPSLSPSGVYEPGKPFGTPATEVEIEAVIQAYAKGARDAAAIGASGVEIHGAHGYLIDQFFWAATNQRQDRYGGDMIERLRFATEVIKACREAVGPSFPIFFRYSQFKQVDYKARLCQSPDELAAFLQPLVDAGVDVFDCSQRRFWEPEFEGSPLNLAGWTKTLTGKPTMTVGSVGLDGDVVASLREGVDVIAASSLDKLDVMLDRGDFDLVGVGRALLADPHWVEKVRDGQTDGLAGFTRAALETLV

SEQ ID NO: 12897 - protein, 485 aa, Caulobacter crescentus CB15
MNAPVNLSSDAHKAVMNDVLQRQKAAHLRDGPPSAEKRIQWLNRCIDLLVGHQAEIAKAVNQDFGSRSPEATSLTDVAGSIGPLKHAREHLTKWMKPEKHKTTPAILGLFGAKATVQWQPKGVVGVISPWNFPVNLTFAPLAGVFAAGNRAMIKPSEFTPATSDLLKAMFAKAFNEEEVAVFVGGPEVGQAFSGLAFDHLVFTGATSVAKHVMRAAAENLVPVTLELGGKSPVILSRGADMATAAARVMNGKTLNAGQICLAPDYVLAPQEDVEAFVKEAQAAVSRYFPTIKDNPDYTAVVAQRHYDRVKGYVDDARAKGARVIEINPAGEDLSQQEHRKIPPTLILDPTDDMKVMQEEIFGPVLPVKGYKTVDEAVDYVNAHDRPLALYWFGTDEAEKDRVLERTTSGGVTVNDVIFHVAQENLPFGGIGPAGMGAYHGYDGFREFSHRKAVFQQLKKDIAPMLGLRPPYGEGIRKYLAGQIKK

SEQ ID NO: 12898 - protein, 253 aa, Caulobacter crescentus CB15
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 12899 - protein, 483 aa, Caulobacter crescentus CB15
MAREILTVAEMAASDRAAVLAGTPIPVLMERAGEAVAQAVRARYQRRPVVVWCGPGDNGGDGYVAARHLRRHGWPVVVEAAYPPATDACRWAASRWRGEVKPLSQRLAAEALYIDAMFGAGLSRPLEGEVAELARTAVRQALTIVAVDTPSGVHGDTGRSLDGVALAAELTITFHRRKPAHVLIEGRKACGDILVSDIGLSTVASAALFENDPSLWRERYPWPAIDAHKHSRGRLSVVSGDAWNTGAARLAARGGLRIGAGAVTLLSPPSALSVNASHLEAVMLASFESDADLAARAEKADAVIIGPAAGVGDATARNLRALTQTGAALVADADALTSFRDDPGELFACLDRDDVLTPHPGEFERIFPGLLGRSPERITAAREAASAAGAVILLKGADTVIAAPDGRAAVGLNGTPWLATAGSGDVLAGFIGGLLAQGMGSFEAACAGAWIHAECGALHGPGLIAEDLPGLAPAILARLHQER

SEQ ID NO: 12900 - protein, 510 aa, Caulobacter crescentus CB15
MQHILEELERRRQQAKAGGGETRVASQHAKGKLTARERIELLLDEGSFEEFDMFVEHRCADFGMQDQKIPGDGVVTGWGTINGKVVYVFSKDFTVFGGSLSNAHAQKIVKVQRQAMKVGAPVIGLFDAGGARIQEGVDSLAGYADIFVENVMASGVIPQISVIMGPCAGGDVYSPAMTDFIFMVKDTSYMFVTGPDVVKTVTNEVVTAEELGGARVHAAKSGVAEGAFENDLEAMTQVRRLIDFLPSSNREPAPERESFDEPLRDEMSLDTLVPADPTKPYDMKELILKVVDEADFFEISSEWAKNIICGFARMDGETVGIVANQPQVLAGVLDIDSSRKAARFVRFCDAFNIPIVTFVDVPGFMPGTKQEYGGLIKHGAKLLFAYTEATVPKITVITRKAYGGAYDVMSSKHLRGDLNYAWPTAEIAVMGAKGAVEIIFRQEAKDPEALAAREAEYKDRFANPFVAAQRGYIDDVIMPHGTRRRIVRGLKSLKGKELSNPWKKHDNIPL

SEQ ID NO: 12901 - protein, 333 aa, Caulobacter crescentus CB15
MHLARFPRARFAHLPTPLEPMPRLGAELGIDLWVKRDDCTGLAGGGNKTRKLEFLLGEALIQGADTLVTQGAVQSNHVRQTIAAGARFGLKTEVILEERTGSKASDYMGNGNVLLDKLMGASLRYVPGGTDMVAELDSTAENVRQRGGKPYVIPGGGSNTVGALGYVDCARELVVQADQMDLKIDRLVTATGSAGTHAGLVAGFAALSVDIPILGFGVRAPKPKQEENVYNLAVATAETIGAGGRVRREAVVADCDYVGEGYGLVDQGVIDALALAARTEGLLLDPVYSGKAMKGLIDQARKGAFKGERVVFLHTGGAQGLFGYQTVLEPALG

SEQ ID NO: 12902 - protein, 476 aa, Caulobacter crescentus CB15
MIRARRSRIVATLGPASSSFDMIVTLAKAGADVFRLNFSHGAHETHAAVYAAIREAEKVVNRPLGVLADLQGPKLRVGKFADGPVMLKAGQAFRFDSDPAPGDETRVHLPHPEILTAMRPGATLLLDDGKLRMTVTDAGPGYANTKVVNSGKLSERKGVAVPDVVIPMSPLTAKDREDLAFALRLGVDWVALSFVQAPEDMAELRRIVEGRAAVLAKIEKPQALKVLGPILDLCDGVMVARGDLGVEMAPEEVPVAQKEILRAARERGIPVIVATQMLESMTSSPTPTRAEASDVANAVYEGADAVMLSAESAAGDYPEESVSMMNRIIERVERDPKWPELMYAEQSHDDVDADVLVVAAAGAAKSGSTKCLVAFTTTGATARRLSRERPLQPVLALSPEISAVRRMCLVWGVEPRVSAQPDSLEVVTTDASSKALELGLVAPGERLLVVAGTPFGAPGAANLLRLAHAPAPARRR

SEQ ID NO: 12903 - protein, 296 aa, Caulobacter crescentus CB15
MLDHRPGDRHVERPERLRAVLDALNDDPNLALDPMDAPLVEIEDLLRVHPKAYVDAVFAAAPSTGRVALDPDTVLSAGSLAAARRAAGASVAAVRAVADGMTERAFCAVRPPGHHAEPGVAMGFCVFSSVAVAARAAQAAGLQRVAIVDFDVHHANGTQAVFEHDPTVFVASIHQSPLYPGTGDPSETGLGNIANATVPAHASRETWRSRFEGLMDKVDAFAPELVIVSAGFDAHARDPLSAQSLEEDDFAWATRAILSVARARGKGRVVSSLEGGYDLQALGRSAAAHVRALQEE

SEQ ID NO: 12904 - protein, 363 aa, Caulobacter crescentus CB15
MSLDALFQPFEFKSLKLPNRVVMAPMTRSFSPGGVPTDEVAAYYRRRAENQVGLIVTEGTGVARPASLNDANVPRFHGEKELAAWKKVVDEVHAAGGKIAPQLWHVGAAKGKDVLGKVDSPSGLSKAGGNPFTEPMTDAEIADTIQAFATAAADAKRLGFDTVELHGAHGYLIDQFFWQGTNVRSDAWGGPTIGERGRFAAEILKAVRAAVGPDYPVIIRLSQWKQQEYTARLAETPKEMEAWLQPLADAGADIFHCSQRRFWEPEFEGSDLNFAGWAKKLTGAPTITVGSVGLSGEFIAAFGGEGSQPTSIDNVIGGLERGEYDMVGVGRALLQDPEWVTKIREGRSDELKAFERAALGTLY

SEQ ID NO: 12905 - protein, 469 aa, Caulobacter crescentus CB15
MALGGAALGLSACEGPGETDLTPKGRQFPKDFVWGVATAAFQTEGSQTADGRGPSIWDVFERVPGHVKNGDTAADATDSYRRYQDDVDLIAGASLSAYRFSMSWSRILPTGAGAVNAAGLDHYSRLVDALLAKGITPYATLFHWDLPQGLQDKGGWANRDTAQRLADYARAVVERLGDRLKNYIILNEAAVHTVFGHVLGDHAPGLKDAALLGPVTHHMNLGQGLAIQALRAARSDLSVGTTMALQPCRPAGGPLAFWNRLASDGLDEIWNLAWLDPLFKGTYPKAMEEPLKGVVRDGDLKTTRQPVDFLGVNYYAPAYVRLDLSAPSKIAAAAAPNSAEQDAFGRHIDPSGLFEVLDRVRREYGAPKMLVTENGCSDPFSSGPAILDDTFRIKYLRRHLEAVLAAREAGCDVRGYFEWTLIDNFEWDLGYTSKFGITTMEAASGRRIPKASYGWFKALAQTGTLPSSP

SEQ ID NO: 12906 - protein, 378 aa, Caulobacter crescentus CB15
MDFALGETADAIRETTARFAADKIAPIAAKIDETNSFPRELWVPMGDLGLHGITVEEEFGGLGLGYLEHVVAMEEVSRASASVGLSYGAHSNLCVNQIRRWATPEQKARYLPKLISGEHVGSLAMSEAGAGSDVVSMKLRAEQVGDRYILNGTKFWITNAPHADTLVVYAKTGEGSRGITAFIVEKGMKGFSVSKKLDKMGMRGSDTAELVFEDCEIPEENVMGPVGGGVGVLMSGLDYERAVLAAGPLGIMQACLDVVLPYVRDRKQFGQPIGSFQLMQGKIADMYVALNSARAYVYAVAKACDAGKTTRFDAAGAILMASENAVKVSLEAIQALGGAGYTKEWPVERLLRDAKLYDIGAGTNEIRRFLIGRELIGG

SEQ ID NO: 12907 - protein, 176 aa, Caulobacter crescentus CB15
MNDLPKPEVLISEAEIAERVQKLAEQIAPRIDDDTVVVCLLTGGLWFAADLTRALWKAGRDVRFDALWLASYHDERKSSGRCEVRADLQRPLVGRRALVVDDVFDTGLSLSEAARLVKDAGASEVLTAVFARKPWPKDRGMEPDFVAWEAPARYLVGYGLDDEGKSRGLPYIGAMD

SEQ ID NO: 12908 - protein, 404 aa, Caulobacter crescentus CB15
MRAFCVGGGPVAENPKDWDVATKLIRGGIARSQFMETAEALYLTQGFTYDSAEGADRRFAGEDPGFVYSRFNNPTVKMFEDRLALLEGAEVCRAQATGMASIHAALMGLVRAGDHVVAGRALFGSCRWIVSEWLPRFGVETTFVDATDPKAWEAAMRPNTKAVLVETPSNPVLEITDIRAVSELAHAVGAKVIVDNVFATPIFQKPLELGADVVVYSATKHIDGQGRVLGGAILTSEAINEEFYRDSLRHTGPSLSPFNAWVMLKGLETLDLRVRRQADSAFALANTIAEHKKVQTVLYPFRPDHPGHNVAKAQMTGGGTVIALDLGSREAAFKFLNALEIVDISNNLGDAKSMATHPPTTTHRSVPEAERPSLGVTEGGVRLSVGLESVEDLKRDVIRALDQA

SEQ ID NO: 12909 - protein, 405 aa, Caulobacter crescentus CB15
MSTATSSTTSQHHIMGVYNRAPLAFERGRGARLISTEGEEYLDCVAGIATNGLGHAHPALVEVLKAQAEKLWHVSNIYRIPEQEELADALCANSFADVVFFTNSGTEAVECALKTARKYHSANGQPERIDIYGFDGSFHGRTYAAVNASGNPSYVDGFGPRLPGYSQLTFGDHDAIKAAIASPTTAAIIVEPVQGEGGARSIPTQCLVGLRQLCDEHGVLLIYDEVQCGMGRTGKLFAYEWAEGGEPHIMAVAKALGGGFPIGACLATTEAAKGMTVAAHGSTFGGNPLAMAVGKAALEIIKSPETLDNVKTVSGFFTQQLNGLKDRFPDVIVDVRGKGMLIGVKLIPNNRDFMVLARDEKLLIAGGGDNCVRLLPPLNLTIEEASEAIAKLEKACEAARAKAAA

SEQ ID NO: 12910 - protein, 237 aa, Caulobacter crescentus CB15
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 12911 - protein, 466 aa, Caulobacter crescentus CB15
MADYDFDLFVIGAGSGGVRAARLAALSGAKVAVAEEYRVGGTCVVRGCVPKKFMVYASEVTSQLKTAKGYGWTIEDARFDWKTFLHEKDVEIARLSGIYVTNLQKAGAHLLHGRAQIVDAHTVEVLPKDGSDDAGTYTARKILVATGGRPVRPVFPGAELGITSDEAFHLPTLPKSVLVVGGGYIAVEFAGIYAGLGVQTTLLYRGANILRGFDDDVRMHLADELEKRGIKVVLGCSHKSIEKLDDGRLLSTLSNDLTFETEAVMFATGREPYVQGLGLEKAGVKLNDKGAIAVDKYSKTNVDSIWAVGDVTDRINLTPVAIREGAAFAQTEFYGNPTTFDHDLVASAVFSQPPVGAVGMSEAEARQAFGKVDIYRSIFRPMKVTFYGGQERCLIKLVVKQDDERILGVHVVGPDSPEIIQMAAIAVKMGVTKPQWDSTCAVHPTLAEELVTMREKYVPAEVGGAG

SEQ ID NO: 12912 - protein, 278 aa, Caulobacter crescentus CB15
MTAPAFDAPGAETPDAERYPIEVRGLVSRFGDNVVHDGLDLKVEQGEILGVVGGSGSGKSVLLNSIIGLKTPDDGHVRLFGGDMRVASRRRWSSVERRWGVLFQQGALFSNLTVRENVAAPLYEHTRLPRSEVEAIADLKIAMVGLPARAATLKPAELSGGMRKRAGLARALAMDPELLFLDEPTAGLDPIGAQAFDALIKDLSDSLELTVFMITHDLDSLYTITDRVAVLADKKVVTVAPVGELERSDHPWIKQYFLGPRGRAAAAAKEHAKSRTDD

SEQ ID NO: 12913 - protein, 324 aa, Caulobacter crescentus CB15
MKAVTCRRYGSPDMLAIETIERPKPRRDEVLVRVTNSTVTSGDTRLRGFRGPLLFWLPLRLAFGVFRPRQPITGMEFAGDVVALGSAVKGLRPGDRVFGMKLGGANAEYVTVKATAALARCPDRLSDDQCAATPFGALSALTFVRDTAELRPGERILIYGASGAVGVFAIQLAKILGAHVTAVSSARNLQMVLDLGADRALDYAAPDFRLEAEAYDVILDTVGATRFSQCRHALGPTGRHVFAEVDGGRLLQSLWTSFCSGPRVLCGFSAGDSPEDMTLIARHLDRGVLRPVIDRRYTMAQIIEAHRYVELGRKRGAVVIRVAD

SEQ ID NO: 12914 - protein, 366 aa, Caulobacter crescentus CB15
MQVTAAVTRSPSGPFSLEALDIEPPRAGEILVRVVATGVCHTDMVMRDQHLPTPQPVVLGHEGAGVVEQVGPGVAKVAVGDHVVMTFNSCGRCPSCSDHAPTYCHEFFPRNFMGAREDGSSGLSKGSEVIHANIFGQSSFATYALCHERNAVKVDKTAPLERLGPLGCGVMTGAGAVMNALKVPAGRSLVVFGAGAVGLSAVLAAKAIGAGPIIAIDINPERLALALELGADHALNGAEGGVVEKIQAITGTGAHFSIDTTANLKVMRQAVDCLGARGVCGLVGASKMGDELPLDAVSVMSGGKVVRGVVEGDADPDVFIPELIALHLAGRFPFDRLIQFYPLAEINQAVSDGETGRVIKPVVRMS

SEQ ID NO: 12915 - protein, 487 aa, Caulobacter crescentus CB15
MSEPLLSADAWTDRLFSDGWVKPSGGVIAVQEPATETVLTQVGRADRSDVARAAASAKAAQPAWAALTADARQAILLRAADLLVEHAPDLAPWIMRESGSVAAKAAVELEHAAGFVRQAGAMATEAAGLVLPSSPGKTSIARRVPLGVVAVISPFNFPLVLSIRAVAPALATGNAVVLKPDPRTPISGGFLIARVFEAAGLPAGLLHVLPGDAEAGDALCRDPNIAMVAFTGSTGAGRKVGEVAGAHLKKVALELGGKNPLIILDDADPDVAASNAAWGAWLHQGQVCMTAGRLLVQRGIHDAVVERLAAKAGHLPVGDPMRGDVALGPLISRGQLDRVHAIVSDTVADGARLVAGGTHKGLCYAPTVLTGVAPGMRAFEEEIFGPIAAVTVFDDLDEAARLANDGPYGLSAGIISGSVGRAMTLGAKLEVGHLHINDQTVDAGPHSPFGGMKASGNGTRISGPANLDEFTTWRWETVKAAATAYPF

SEQ ID NO: 12916 - protein, 496 aa, Caulobacter crescentus CB15
MTPIDHVAFQARLQPGGLAAVELANGRRWTYAELDADIARAVGVLRRRGVGEGDRLAVLAKNQVLLVILHLACARLGAMFAPLNWRLSASELHALIEDADPAMIVGDDQLAAAGLDGVDLDVLRAEIDCADPDTRARADRERPSLILYTSGTSGRPKGALLSERNLDQTAINFGRLGKVTHESVFLVDAPMFHIIGLITSIRPVLMHGGAILVSDGFEPARTLGRLGDPTLGITHYFCVPQMAAMLRRQPAFDASALRRLTAIFTGGAPHPAPDIRAWLAEGIPMVDGYGMSEAGTVFGMPADATLIDARAGSAGLCMPPVFTRIVDEQDRDCPPGVPGELLLKGDNVFRGYWRRPEDTARAFTEDGWFRTGDIALADAEGYHWLVDRKKDMFISGGENVYPAEIEAALADHPAILECAVVGVPDPRWGEVGHLVVTCREGAVLDLALILSHLEDRLARYKLPKALTLVAALPRTASGKIQKTVLRERLLAGDPRT

SEQ ID NO: 12917 - protein, 470 aa, Caulobacter crescentus CB15
MSSPQAVFERRDPVTGAVATTSIAMTADQARVAVDAAQAALPTWSALGPNARRALLSKAAAALEARADDFVAAMMGEIGATEGWARFNLMLAASMVREAAALTTQVSGEVIPSDKPGCLAMAVREPVGVILGIAPWNAPIILGVRAVATPLACGNTVVLKASESCPRTHELIAEAFAAAGLPEGALSIVTNAPADAAEVVGALIDHPAVRRINFTGSTAVGKIIAKRAAEHLKPVLLELGGKAPLIVLEDADLDEAVKAAAFGAFMNQGQICMSTERIIVVDAIADAFVAKFAAKASSLAVGDPREGKTPLGAVVDLKTVTHVQGLVADALADGAVQVSGGPANGVLMPATVVDKVTPAMRLFREESFGPVVAVIRARDEEHAIALANDTEYGLSASVFTRDIARGLKVARRIQSGICHVNGPTVHDEAQMPFGGVKASGYGRFGGKAGVDAFTELRWITVETQPGHFPI

SEQ ID NO: 12918 - protein, 241 aa, Caulobacter crescentus CB15
MKSKIYESAAAALEGVVFDGMTLMSGGFGLSGNPETLIPALKDTGVKALTVISNNCGADGFGLWMLLNNGQIRKMVSSYVGENKLFEQLYLSGELELELNPQGTLAERIRAGGAGIPAFYTKTGVGTVVAEGKPVETFEGEPYLRETWLRADLSIVKAWKADPEGNLVFRMTARNFNPVMATAGKVTIVEVEEIVEAGELDANAIHTPGIYVDRIVKSTINEKRIEKLTTRPREIHAGETV

SEQ ID NO: 12919 - protein, 369 aa, Caulobacter crescentus CB15
MKTRAAVAFEAKKPLEIVEVDLEGPKAGEVMVEIKATGVCHTDAYTLDGFDSEGIFPSILGHEGAGVVVEVGAGVTSVAVGDHVIPLYTPECRQCKSCLSGKTNLCTAIRATQGKGLMPDGTSRFSYKGQPIYHYMGCSTFSNYTVLPEIAVAKIRRDAPFKTACYCGCGVTTGVGAVTNTAKVEPGANAIVFGLGGIGLNVIQGLKLVGANMIVGVDINPDREEWGRKFGMTHFVNPKDVQGDLVAHLVALTDGGADYTFDATGNTGVMRTALEACHRGWGESIIIGVAEAGKEISTRPFQLVTGRVWKGTAFGGARGRTDTPKIVDWYMDGKIQIDPMITHVLPLEEINKAFDLMHAGESIRTVVTF

SEQ ID NO: 12920 - protein, 314 aa, Caulobacter crescentus CB15
MARDPYQELGVTRTASADEIRKAFRKLAKQYHPDANSGDKKAEERFKQVSAAFDIVGDAEKRKKFDLGQIDADGRETMRGFGGQPGNGPFNAGGFGQGGFHRSNEGPEIDLSDLFGGMFGGGGPGGAGRGPFSGGAGGGFSAKGADVKARLDIDLEDAIKGGKKRVAFSDGRTIDVTIPTGAQEGQTLRLKGQGSPGRGGQGDALIELAIKPHPIYRREGEALVMDLPVSIPDAVLGGKVEAPTPDGNVMLAVPKGSNSGQTLRLKGRGMPDGKGKRGDLLARLVVTLPETVDQDLEKFAEAWRAQKPYTPKRK

SEQ ID NO: 12921 - protein, 283 aa, Caulobacter crescentus CB15
MSLLKKIAFQGEPGANSHEACRTYFPDYEAYPCKTFEEAFEAIKSGVAQLGMIPIENSIAGRVADVHHLLPASGLKIIGERFKPIRFQLMANKGVKLEDIKVVSSMPIALSQCRNSLKRLGVETEAAGDTAGAAKALALKPNPTHAAVAPALAAEIYGLDILARDIEDERHNTTRFLVMTADKAPAAPDFTHRCVTSFVFRVRNLPAALYKALGGFATNGVNMTKLESYMEGGNFTATFFYAEVDGRPEDRNLALALDELKFFSERFEILGVYPADPFRDRGA

SEQ ID NO: 12922 - protein, 458 aa, Caulobacter crescentus CB15
MDADVRSAPLIPPAPKVHPRQLGGSFVGELRIALEMSRNLMGAWCEEDFDNLFTPYVFMGQPGMVVSDPAAARRILSSPNYVRPVKAARSVRPIAGDGLLLSEGETWRRQRKSLAPVFTPMAVEGLLPHFVAAGASLAEALSGHARADLSEAFHHATLDAVLSALFSRRADAQGDQLAYMVRRYMEGPAHFNLMDFVSRGADDLTFLDVERRRQGAAWFQAVEHLIAQRQAHPHAEARDLLDRLLAARDEDGAPLSNQEIRDQCGTMLVAGFETTSRLLFWATYLLALDPATQDRLRAEVLAAPAAAVRTLDDLQAWPLMRSVLFETLRLYPTAPLLAREAIGPDTVMGHAVVPGQIITISPWLIHRHRKLWDAPTAFVPDRFIDQPHPWGIEAFLPFGAGPRVCIGASFALAEAQIVLASLLERFEIGLVSDRPVIPIASITLGPDHAPAFTLTPVS

SEQ ID NO: 12923 - protein, 333 aa, Caulobacter crescentus CB15
MKTRELGDGLKVSAIGLGCMGMGQVYGTALETGDAFKLMARAVELGVTFFDTAEVYGPFANEELVGQGLKPFRDQVVIATKFGFDIGPEDLGQGMARVRGVNSRPEHIRSVAEASLKRLGIETIDLFYQHRVDPAVPIEDVAGTVKDLIAEGKVKHFGLSEAGAATIRKAHAIQPVAALQSEYSLWFRELEAEILPTLRELKIGLVPYSPLGRGFLAGAVKAETMGEGDFRKGLPRFQGEALQKNLSLVEALSAIAADKGVTPAQLALAWILHQGHDIAPIPGTTKIHRLEENVAAVDVTFSADELARIAAAVPETEIEGERYSKTGMAMVGR

SEQ ID NO: 12924 - protein, 366 aa, Caulobacter crescentus CB15
MKAAVLREVGKPLQIETVAIGKPGPREVLIRTKAAGVCHSDLHFVEGSYTHALPAVLGHESAGIVEAVGSEVRTVKVGDHVITCLNPYCGHCEVCLTGHMNLCISPETRRSKSDAPRLFKEDLNGATGPMAQFLNLSSFAEMMLVHEHACVAIRKDMPFDRAALIGCSVMTGVGAVMHTSNVRPGETVAVIGCGGVGLATINGAAIAGAGRIIAIDRLAGKLELAKTFGATDVVDASQVDDIAKAVVELTGGGVHHSFEAIGLKATAEASFKMLRRGGTANVIGMIPVGTKIELHGVDFLGERRIQGSYMGSNRFPVDMPRLVDFYMSGKLKLDELISRRIKLEDVNSAFDELKRGELARSVIVFD

SEQ ID NO: 12925 - protein, 504 aa, Caulobacter crescentus CB15
MPDLAFLPPEARRWVWAGVVVALYALFCLAIALREAWRGRQARKAADALSQGSGEPVLVAYASQTGFAEELATATAKALADTGAPVTLKDLSAVTAGDLAGRALFVVSTTGEGDAPDPARAFIRDVMKDEADLSALRYGVLALGDSSYAHYCAFGRSLDAWLSGRGGQPLFDRVEVDDADPAALRHWQGQLATLTGVTDAPDWTRPTYDAWTLAERTLLNPGSPGGEAWHLRLTPPKGAVWQAGDIVEIGPRNDPAQVAALIAALDLPAEAADTLAGLRLPQDAAALDALRGLPLEALAERLTALPHREYSIASLPDDGGVELIVRLMTRADGAPGLGSGWLCRHAPIGAAIEARVRVNRSFHAPETKRPLILIGSGTGLAGLRAHLKARAAAGVRWNWLIFGERTAAHDYFHRAELEAWQASGLLDRLDLAFSRDQAERVYVQHRLRESADILRRWVANGAAIYVCGSLEGMSREAHTALVEILGAPMLERLTDEGRYRRDVY

SEQ ID NO: 12926 - protein, 425 aa, Caulobacter crescentus CB15
MLTAAHEPLFAPLVLPNGAVLPNRIAKAAMEENLADPGQLPGPALWTLYRRWAQGGVGLQITGNVMVDPSAVTGPGGVVLDARAPLAPFETWAKEAKSGGGQVWMQINHPGRQTYADLGQGAVAPSAVPVDLGKLSNLLAQPRALTSDEIVALVERYAVTARRAEDAGFDGVQIHAAHGYLLSQFLSPLVNRRDDAWGGSRENRARMLFEVIKAVRARVSPRFVVSVKLNSADFQKGGFDAEDARWVVEQMNGMGVDLVELSGGNYENPAMQGPTKADAIAQTSTTAREAYFVDFARDIAKVAKMPIMVTGGVCRRAVALAALSPEGALPGVPVIGIARALAFAPDLPNAWRKPEGQDVVLPEVTWKNRSLAGLAVMALTKAQLNRLAAGKAPARKLSPLLTVISQRIKQSAQTKRYRAWRLSNP

SEQ ID NO: 12927 - protein, 467 aa, Caulobacter crescentus CB15
MNAPIRNHDVAELKRLDLAHHLPAQADHKVIAELGGSRIVTRADGCYITDGDGHRILDGMAGLWCVNVGYGRKELADAAYEQMLELPYYNTFFKTATPPTVKLAAKIAEKMGGHLTHVFFNSSGSEANDTVFRLVRHYWKLKGQPNRTVFISRWNAYHGSTVAGVSLGGMKHMHVQGDLPIPGVEHVMQPYPFGEGFGEDPAAFRDRAVKEIEDKILEVGPENVAAFIGEPVQGAGGVIIPPDGYWPAVEAVCRKYGILLVCDEVICGFGRLGQWFGHQHYGIKPDLIAMAKGLSSGYLPISAVGVADHIVAELREKGGDFIHGFTYSGHPTCAAVALKNIEIIEREDLITRTREDTGPYLAKALARLNDHPLVGETRSLGLIGAVEIVREKGTNHRFLDKEGEAGPIVRDICIRNGLMVRAIRDSIVCCPPLIVSHAEIDELVGIIEKSLTEAEPILRALKPEAVS

SEQ ID NO: 12928 - protein, 460 aa, Caulobacter crescentus CB15
MMSAVADIQECRDFLAAHPQVKFVEVFFTSMTGVPRGKRLRVHELEAIYEYGRFLPGSVLVVDTNGADCEDTGLVWEDGDADRRARPVPGTLTLAPWLGPDVAQVMLSLYELDGTPNDLDPRHVLQRVLDRYAADGLTPVAACELEYYLVDLQRGPNGELLPAKSLQTGLRPTGIQVYGLPELEAHAPFLRELWDVADTLGVPLEGAISEFAPAQVELTLKHKPDALRAADDAVLYKRAAKGVALRHGMEATFMAKPWSDRAGNGFHVHLSVNDAAGNNLCASEDIEGSDLLKHAIGGMKVLLGEGMAILAPNANSYRRFKANSYAPVAPTWGVNNRTVSLRVPAGPPKTRHVEHRVAGADGNPYLVLAVLLASAHHGITNKIDPGPAVIGDGYAAAAKENIRLPNNWFAAVDLFEQSSVLRDYLGDRFVDMFVSVKRTEQARFFEVVTELDFDWYLRNA

SEQ ID NO: 12929 - protein, 466 aa, Caulobacter crescentus CB15
MGPAHEARDDGGGGGGMIAELAKSLSDLLTAERARFTVEHPRSVAMAKAAGAHWRGGAPMHWMNDWASPSPIFAAQGVGAQITDVDGKLYDDFCLGDTPSMFGHGDPSVAAAVSDQIKRGAGFMLPTASAAIVGKLLSERFGLPLWQAATTASDANRAAIRWARAVTGRPVILVFDGCYHGMVDDAFVVLKDGAPVMKPGLLGQVHDLTATTRVVAFNDLAALEAALAPGDVAAVLAEPVMTNCGMILPEPGFLEALRRLTREAGTLLVIDETHTISTGPGGYTRAHGLEPDVFVLGKAVAGGVPAAVWGVTAELSARMDAAQQRIGPGQSGIGTTLSGNALAMAAMRAMLSEVMTEAAYGKMLAGAERLVAGLNAVIAARRLPWSVVHVGARVELVFADPPPKNAAQMRKVLDHEAVEALHLWLINRGVLIAPFHNMMLVSPVTEDAAIDRLVAAVDGFAAAMGE

SEQ ID NO: 12930 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 12931 - protein, 496 aa, Caulobacter crescentus CB15
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 12932 - protein, 439 aa, Caulobacter crescentus CB15
MPDFGANDLDAFWMPFTPNRRFKRHPRMLSSASGMWYRTPESREVLDATSGLWCVNAGHDRPKIREAIQKQAAEMDYAPCFNMGHPLAFQFASRLAQITPKGLDRIFFTNSGSESVDTALKIALAYHRARGKGTKTRLIGRERGYHGVGFGGISVGGIPKNRMYFGSLLTGVDHLPHTHGLPGNTCAKGQPENGAHLADDLERIVALHDASNIAAVIVEPVAGSTGVLIPPKGYLERLRAICDKHDILLIFDEVITGFGRVGAPFAAERFGVTPDLICMAKGLTNAAVPCGAVAASGKIYDAMMDGADAPIELFHGYTYSAHPLACAAGLATLETYREDDLFARAAGLEGYWQDAMHSLADARHVVDVRNLGLVAGIELEPRPGAPTARAMEVFETCFDEGLLIRVTGDIIALSPPLILEKDHIDRMVETIRRVLGQVD

SEQ ID NO: 12933 - protein, 451 aa, Caulobacter crescentus CB15
MFSRHLRAAAGALALTLAAAPALAGDVTAFPGAEGAGRLSLGGRGGAVLRVTNLNDSGPGSLRAAVEAKGPRTVVFDVAGTISLKSPLKISNPRITIAGQTAPGGGITLRDQTLVVGADDVVIRFIRSRLGAESKVEGDAIWISGGRRIILDHVSASWSVDETLSASARYTEAGQGFHDLTVQWSIIAESLARSIHVKGDHGYGSLIRGGQGSRISFHHNLWANHIARMPRPGNYDGPDKDPVGPLFDFRSNVFYNWGKGYAGYNADKAARAAYNFVDNAYVPGPDTGKRVIFQESNLEAKGYFAGNSMDGVVPADPWSLVTFTITEPAGYRLAAPLDVAPVTPESADKAYERVLADAGASVWRDPVDRRIVEGVRSRQGKVINTQADVGGWPELPVGKALADTDGDGMPDAWEKTRGLNPKSPDGAILAKDGSGWTNLELYLADAAKVRG

SEQ ID NO: 12934 - protein, 401 aa, Caulobacter crescentus CB15
MRDDQTGFSTRAIHAGYDPADEHGALTPPLHLTSTFAFESAEAGGEMFAGTREGHFYSRISNPTTDLLERRLASLEGAEAAVATASGMGAITATLWSFLRAGDEVITDQTLYGCTFAFLRDGLTRFGVTVKQVDMTRPETLAAAISDQTRIVYFETPANPNMRLVDIAAITRIAHAAGAKVVVDNTYATPCLTRPLALGADIVVHSATKYLGGHGDLVGGIAAGGIEDMARVRLCGVKDMTGAVMSPFTAFLVLRGLKTLSLRMARHSQSAQAVARWLEDHPAVEQVFYPGLQSFPQRDLAARQMAAGGGMMAFELKGGHAAGVAMMNRLALIRRAVSLGDAETLIQHPASMTHSPYTPEERAAAGIGEGMVRLSVGLEDVADILADLAMALEPLKVAQPA

SEQ ID NO: 12935 - protein, 396 aa, Caulobacter crescentus CB15
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 12936 - protein, 320 aa, Caulobacter crescentus CB15
MTAIAIEGGKGPAQALHATRLDRPTPGPGEILIKMAAAGVNRPDLLQRMGFYPPPPGAPATLGLEVAGEVVVGAGRWKAGDKVCALLGGGGYAEYAVVDARHALPIPGDLDLVQAAALPETVFTVFANVFEHGALKAGETLLVHGGTSGIGTTAIAMAKAAGAKVIATGRGADKKAKALELGADIAVDTKAEDFAEVVKAAGGADVILDMVGASYFDKNLDALNVGGRIVYIASLGGSTLEVPVMKIMQKRAVITGSTLRPRSADEKARLAAEVERVVWPWVAAGKLKPIIDATFPLADAAKAHAHLEAGEHVGKVVLTV

SEQ ID NO: 12937 - protein, 172 aa, Caulobacter crescentus CB15
MTELDHPQHRPNVGVVLFHPDGRVWLGRRHRQAPPYNWQFPQGGVDEGEDLEVAARRELAEETGVTSVELLGRTEGWITYDFPPEVMANPKHARGWRGQKQVWFAYRFVGEESEIDLEADEHIEFDAWRWGRLDETPELIVPFKRGVYEAVVAAFQGFARGDSPVRRREGEN

SEQ ID NO: 12938 - protein, 412 aa, Caulobacter crescentus CB15
MSAEVNQNACVVIVGAGHAGGSVAAFLRQYGHEGRIVLIGDEPLLPYQRPPLSKAWLKGEADADSLSLKPAGWYADNNVMLRLGGVAERINRSDKTVALASGEVIPYDFLVLATGARARELPIPGADLAGVLALRTAADAELLKNALGPDKRLAVVGGGYVGLEAAASARALGSHAMVIERESRVLARVACETLSHFFQDYHGKHGVAFELNAGVAAFEGHDGHVTGVRFNDGRVVACDVALVGVGAVPNDELAKDAGLSTANGVVVDLEARTDDPSIFAIGDVTHRPLPLYDRQFRLESVPNALEQAKQAASAILGRPGPAPETPWFWSDQYDLKLQIAGLPFDADRQVVRGDVAAAKFAVFHLKGDLVQAVEAVNAPPEFMAGKQLIAKRTPVDANKLADPSVSMKEVAA

SEQ ID NO: 12939 - protein, 275 aa, Caulobacter crescentus CB15
MTKDRIDRRFAALKAENRAGFVTYVMAGDPDAATTLSVLKGLPAAGADLIELGFPFSDPMAEGPTIQRAAQRGLKSGMTLQGTLDLVAAFREGDQDTPIILMGYLNPVLNKGFETFAALAAKAGVDGLIIVDCPPEEADPLSDALEAEGIALIRLAAPTTDDARLPMVVRRTSGFVYYVSVAGVTGVKSADAADVAPAVERLRKASGLPVAVGFGIRTPDQAAAVAKVADAAVVGSALVDEIESAAQLNENVTEKVLLKASELAKAVRSARVGTK

SEQ ID NO: 12940 - protein, 506 aa, Caulobacter crescentus CB15
MTKPEFIESLSRPPFKARYDNFIGGQWVAPADGRYFDNSSPIHGRKICEIARSQAIDIERALDAAHAAKAGWARTSAADRSRILLRIADRMEENLAALATAETWDNGKPIRETLAADIPLAIDHFRYFAGCLRSQEGSISEIDHDTIAYHFHEPLGVVGQIIPWNFPLLMACWKLAPALAAGNCVVLKPAEQTPASIMVWAEMIGDLLPAGVLNIVNGFGLEAGKPLASSPRIAKIAFTGETSTGRLIMQYAAQNLIPVTLELGGKSPNIFFDDVAREDDDYLDKALEGFTMFALNQGEVCTCPSRALVQESIYEKFMERALKRVNAVVQGSPLDPATMIGAQASEEQLNKILGYMDIGRNEGAKLLAGGQRKILPGQLADGYYVEPTVFEGHNKMRIFQEEIFGPVLAVTTFKTEEEALEIANDTAFGLGAGVWSRDANRCYRFGRGIEAGRVWTNCYHAYPAHAAFGGYKQSGVGRETHKMMLDHYQQTKNMLVSYSPKALGFF

SEQ ID NO: 12941 - protein, 481 aa, Caulobacter crescentus CB15
MAERMLKFTTVARKTPEKRAAAERSGDFHEIYADFIDAKATEQASRCSQCGVPFCQTHCPLHNNIPDWLRMTAEGRLEEAYALSQATNSMPEVCGRICPQDRLCEGNCVIEQSGHGTVTIGSVERYLTDKAWEMGWVKPLAAGPARGQSVGIVGAGPAGLAAAEKLREAGYDVTVYDRHDRAGGLLIYGIPGFKLEKDVVERRTQRLADGGVVFKLGFEVGKDATLEDLRAQHDAVLIAVGVYAARDLTVPGGGSKGVVPALDYLITSNRLSLGDSVPAYDSGELNAEGKDVVVVGGGDTAMDCVRTAIRQGAKSVTCLYRRDKANMPGSMREVANAEEEGVTFEWLAAPRALSGEAEAVTGVRAIRMRLGAPDASGRQSPEEIPGGDFDRPAQLVVKALGFEPENLPEQWSAPDLKVTRWGTVKADVRNQMTNLDGVFAAGDIVRGASLVVWAIKDGRDAADAIHRYLLAKASSTLIAAE

SEQ ID NO: 12942 - protein, 436 aa, Caulobacter crescentus CB15
MAAIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 12943 - protein, 328 aa, Caulobacter crescentus CB15
MDDASSLYDAARFKRAGRGKIYDSIIDTIGDTPLVRLPRLSAELNPKAEVLAKLEFFNPIASVKDRIGVSMIESLEAQGVLKPGATIIEPTSGNTGIALAFVAAAKGYKLTLVMPESMSIERRKMLLLLGAKLELTPAEKGMRGAVTRAQELIEATPGAVMPQQFENSANPLIHRVSTAEEIWNDTAGAVDAVVSGVGTGGTITGVGQALKARKPSLKMVAVEPEASPVLSGGAPGPHKIQGIGAGFVPGVLDRGVIDDIVQVSNDDAFAMARRAAATEGLPVGISSGAALTAAFDLALRDAYKGKTIVVIIPSFAERYLSTALFDGL

SEQ ID NO: 12944 - protein, 177 aa, Caulobacter crescentus CB15
MLAGRRILIEVPMHRRALLVTLAAAGVALSACGPSKKAQENLAAADAFMAKNAKEPGVVTLPQGLQYKVVREGPNGGMHPNKADEVKVHYEGKLIDGTVFDSSYERGVPAVFPLDGLVPAWVIALQRMKAGDEWILYVPPALGYGAQDKGPIPGNSVMIFRIELLDVNRIGPGKPKE

SEQ ID NO: 12945 - protein, 256 aa, Caulobacter crescentus CB15
MTSQVPKLAWKGVTKQFGDRKVLDQLDLSVAPGRSLVIIGGSGQGKSVTIKTALGLLRPEAGAIELDGKNVVGLSETQRRKLFSRVGVLFQGAALFDSLTIWENVAFRLINADGVPRRKARDRAIEALEQVRLSADVAERFPSELSGGMQKRAGLARAVVARPEILFFDEPTTGLDPITAAAINQLISDQVRRLGSTAVSITHDLASAQTIGDEIAMLHGGKIIWRGPAAELATTDNPYVRQFVEGRAEGPISETH

SEQ ID NO: 12946 - protein, 344 aa, Caulobacter crescentus CB15
MLQLSNACQRELFKPPMAARKLKVIVTRKLPDPVETRMCELFDTELNVSDKPMTADELVDAMSRADVLVPTITDRIDSRLLSRSGDRLKLIANFGAGVDNIDVATANARGIIVTNTPGVLTEDTADLTMTLIMAASRRIVEGAEVVKAGGFHGWSPTWMMGRRLWGKRLGIIGMGRIGQAVARRAKAFGMQVHYHNRKPVSPRIAEELGCTYWESLDQMLARMDFVSVNCPHTPATYHLLSARRLKLLRPHAVVVNTARGEVIDEGALANMLAKGEIAGAGLDVYEHEPAINPKLLKLPNVVLLPHMGSATVEGRIDMGEKVIVNVKTFMDGHRPPDRVIPAML

SEQ ID NO: 12947 - protein, 443 aa, Escherichia coli K12
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 12948 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 12949 - protein, 426 aa, Escherichia coli K12
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 12950 - protein, 352 aa, Escherichia coli K12
MERTMTQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVPRAELKARVKEALAMVDLEGFEDRFVDQISGGQQQRVALARALILKPKVLLFDEPLSNLDANLRRSMRDKIRELQKQFDITSLYVTHDQSEAFAVSDTVLVMNKGHIMQIGSPQDLYRQPASRFMASFMGDANLFPATFSDGYVDIYGYHLPRPLHFGTQGEGMVGVRPEAITLSDRGEESQRCVIRHVAYMGPQYEVTVEWHGQEILLQVNATRLQPDVGEQYYLEIHPYGMFVLADAA

SEQ ID NO: 12951 - protein, 450 aa, Escherichia coli K12
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRMLGASLLCVDSHEMINIVKMVMDAGLPYSILRDQIFTHPSMSESLNDLFSLVK

SEQ ID NO: 12952 - protein, 490 aa, Escherichia coli K12
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 12953 - protein, 349 aa, Escherichia coli K12
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 12954 - protein, 369 aa, Escherichia coli K12
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 12955 - protein, 457 aa, Escherichia coli K12
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 12956 - protein, 319 aa, Escherichia coli K12
MKPENKLPVLDLISAEMKTVVNTLQPDLPPWPATGTIAEQRQYYTLERRFWNAGAPEMATRAYMVPTKYGQVETRLFCPQPDSPATLFYLHGGGFILGNLDTHDRIMRLLASYSQCTVIGIDYTLSPEARFPQAIEEIVAACCYFHQQAEDYQINMSRIGFAGDSAGAMLALASALWLRDKQIDCGKVAGVLLWYGLYGLRDSVTRRLLGGVWDGLTQQDLQMYEEAYLSNDADRESPYYCLFNNDLTREVPPCFIAGAEFDPLLDDSRLLYQTLAAHQQPCEFKLYPGTLHAFLHYSRMMKTADEALRDGAQFFTAQL

SEQ ID NO: 12957 - protein, 292 aa, Escherichia coli K12
MKLGFIGLGIMGTPMAINLARAGHQLHVTTIGPVADELLSLGAVSVETARQVTEASDIIFIMVPDTPQVEEVLFGENGCTKASLKGKTIVDMSSISPIETKRFARQVNELGGDYLDAPVSGGEIGAREGTLSIMVGGDEAVFERVKPLFELLGKNITLVGGNGDGQTCKVANQIIVALNIEAVSEALLFASKAGADPVRVRQALMGGFASSRILEVHGERMIKRTFNPGFKIALHQKDLNLALQSAKALALNLPNTATCQELFNTCAANGGSQLDHSALVQALELMANHKLA

SEQ ID NO: 12958 - protein, 164 aa, Escherichia coli K12
MVTFHTNHGDIVIKTFDDKAPETVKNFLDYCREGFYNNTIFHRVINGFMIQGGGFEPGMKQKATKEPIKNEANNGLKNTRGTLAMARTQAPHSATAQFFINVVDNDFLNFSGESLQGWGYCVFAEVVDGMDVVDKIKGVATGRSGMHQDVPKEDVIIESVTVSE

SEQ ID NO: 12959 - protein, 241 aa, Escherichia coli K12
MITLKNVSKWYGHFQVLTDCSTEVKKGEVVVVCGPSGSGKSTLIKTVNGLEPVQQGEITVDGIVVNDKKTDLAKLRSRVGMVFQHFELFPHLSIIENLTLAQVKVLKRDKAPAREKALKLLERVGLSAHANKFPAQLSGGQQQRVAIARALCMDPIAMLFDEPTSALDPEMINEVLDVMVELANEGMTMMVVTHEMGFARKVANRVIFMDEGKIVEDSPKDAFFDDPKSDRAKDFLAKILH

SEQ ID NO: 12960 - protein, 1320 aa, Escherichia coli K12
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEESDRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVVDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAKYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSAVSERIQLAKAENITAQPFDAVIFHGDSDQLRALCEAVAARDGTIVSVQGFARGESNILLERLYIERSLSVNTAAAGGNASLMTIG

SEQ ID NO: 12961 - protein, 474 aa, Escherichia coli K12
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 12962 - protein, 1015 aa, Escherichia coli K12
  misc_feature (196)..(196): Xaa can be any naturally occurring amino acid
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQLDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQSEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 12963 - protein, 470 aa, Escherichia coli K12
MTHKGDTPMTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 12964 - protein, 365 aa, Escherichia coli K12
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMAVQLWHTGRISHASLQPGGQAPVAPSALSAGTRTSLRDENGQAIRVETSMPRALELEEIPGIVNDFRQAIANAREAGFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 12965 - protein, 406 aa, Escherichia coli K12
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPADIRHAAYNDINSASALIDDSTCAVIVEPIQGEGGVVPASNAFLQGLRELCNRHNALLIFDEVQTGVGRTGELYAYMHYGVTPDLLTTAKALGGGFPVGALLATEECARVMTVGTHGTTYGGNPLASAVAGKVLELINTPEMLNGVKQRHDWFVERLNTINHRYGLFSEVRGLGLLIGCVLNADYAGQAKQISQEAAKAGVMVLIAGGNVVRFAPALNVSEEEVTTGLDRFAAACEHFVSRGSS

SEQ ID NO: 12966 - protein, 326 aa, Escherichia coli K12
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVAASLQRLGIDYIDIYMTHWQSVPPFFTPIAETVAVLNELKSEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 12967 - protein, 459 aa, Escherichia coli K12
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 12968 - protein, 480 aa, Escherichia coli K12
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 12969 - protein, 250 aa, Escherichia coli K12
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARELLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGAAKALFADPEQPRTRQFLEKFLLQ

SEQ ID NO: 12970 - protein, 468 aa, Escherichia coli K12
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 12971 - protein, 478 aa, Escherichia coli K12
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDMVAFEVAQFVEKPNLETAQAYVASGEYYWNSGMFLFRAGRYLEELKKYRPDILDACEKAMSAVDPDLNFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 12972 - protein, 412 aa, Escherichia coli K12
MPQQNYLDELTPAFTSLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEVGNTLTLEQLKAENRAVLVTVGLSSGSGLPLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLSGELTMAADKIILAVGQHARLDAFAELEPQRNTIKTQNYQTRDPQVFAAGDIVEGDKTVVYAVKTGKEAAEAIHHYLEGACSC

SEQ ID NO: 12973 - protein, 220 aa, Escherichia coli K12
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGTVVEEGKQTLTLDGKTWLLERPLRADLALIRAHRCDTLGNLTYQLSARNFNPLIALAADITLVEPDELVETGELQPDHIVTPGAVIDHIIVSQESK

SEQ ID NO: 12974 - protein, 257 aa, Escherichia coli K12
MSENKLNVIDLHKRYGEHEVLKGVSLQANAGDVISIIGSSGSGKSTFLRCINFLEKPSEGSIVVNGQTINLVRDKDGQLKVADKNQLRLLRTRLTMVFQHFNLWSHMTVLENVMEAPIQVLGLSKQEARERAVKYLAKVGIDERAQGKYPVHLSGGQQQRVSIARALAMEPEVLLFDEPTSALDPELVGEVLRIMQQLAEEGKTMVVVTHEMGFARHVSTHVIFLHQGKIEEEGAPEQLFGNPQSPRLQRFLKGSLK

SEQ ID NO: 12975 - protein, 304 aa, Escherichia coli K12
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 12976 - protein, 412 aa, Escherichia coli K12
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 12977 - protein, 303 aa, Escherichia coli K12
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 12978 - protein, 365 aa, Escherichia coli K12
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPDQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQRGERLFVGLQHARLYNGDERIETRDEELALAQSA

SEQ ID NO: 12979 - protein, 377 aa, Escherichia coli K12
MSNGIVIIGSGFAARQLVKNIRKQDATIPLTLIAADSMDEYNKPDLSHVISQGQRADDLTRQTAGEFAEQFNLHLFPQTWVTDIDAEARVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGIQATLDRQRNIEVDAVIAATGLRPETALARRAGLTINRGVCVDSYLQTSNTDIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPM

SEQ ID NO: 12980 - protein, 474 aa, Escherichia coli K12
MSVFPESFLWGGALAANQSEGAFREGDKGLTTVDMIPHGEHRMAVKLGLEKRFQLRDDEFYPSHEATDFYHRYKEDIALMAEMGFKVFRTSIAWSRLFPQGDEITPNQQGIAFYRSVFEECKKYGIEPLVTLCHFDVPMHLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGTYPAYSARVFREKGVTINKAPGDDEILKNTVDFVSFSYYASRCASAEMNANNSSAANVVKSLRNPYLQVSDWGWGIDPLGLRITMNMMYDRYQKPLFLVENGLGAKDEFAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 12981 - protein, 469 aa, Escherichia coli K12
MTGRCLFGFSGEKPFLLPDNEGVKMNTSPVRMDDLPLNRFHCRIAALTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLRQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 12982 - protein, 1032 aa, Escherichia coli K12
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDTLNKLLQDDAFLARHGLQEKRESLQALPARIPTSMVHGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWDEYKQRWHKPAGSGSRHPVAVIGAGPAGLAAGYFLARAGHPVTLFEREANAGGVVKNIIPQFRIPAELIQHDIDFVAAHGVKFEYGCSPDLTIEQLKNQGFHYVLIATGTDKNSGVKLAGDNQNVWKSLPFLREYNKGTALKLGKHVVVVGAGNTAMDCARAALRVPGVEKATIVYRRSLQEMPAWREEYEEALHDGVEFRFLNNPERFDADGTLTLRVMSLGEPDEKGRRRPVETNETVTLLVDSLITAIGEQQDTEALNAMGVPLDKNGWPDVDHNGETRLTDVFMIGDVQRGPSSIVAAVGTARRATDAILSRENIRSHQNDKYWNNVNPAEIYQRKGDISITLVNSDDRDAFVAQEAARCLECNYVCSKCVDVCPNRANVSIAVPGFQNRFQTLHLDAYCNECGNCAQFCPWNGKPYKDKITVFSLAQDFDNSSNPGFLVEDCRVRVRLNNQSWVLNIDSKGQFNNVPPELNDMCRIISHVHQHHHYLLGRVEV

SEQ ID NO: 12983 - protein, 479 aa, Escherichia coli K12
MIVKKLTLPKDFLWGGAVAAHQVEGGWNKGGKGPSICDVLTGGAHGVPREITKEVLPGKYYPNHEAVDFYGHYKEDIKLFAEMGFKCFRTSIAWTRIFPKGDEAQPNEEGLKFYDDMFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQRPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 12984 - protein, 464 aa, Escherichia coli K12
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 12985 - protein, 472 aa, Escherichia coli K12
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGSDNAFQTSNPKIFAGGDIVRGSDLVVTAIAEGRKAADGIMNWLEV

SEQ ID NO: 12986 - protein, 252 aa, Escherichia coli K12
MSQILLQPANAMITLENVNKWYGQFHVLKNINLTVQPGERIVLCGPSGSGKSTTIRCINHLEEHQQGRIVVDGIELNEDIRNIERVRQEVGMVFQHFNLFPHLTVLQNCTLAPIWVRKMPKKEAEDLAVHYLERVRIAEHAHKFPGQISGGQQQRVAIARSLCMKPKIMLFDEPTSALDPEMVKEVLDTMIGLAQSGMTMLCVTHEMGFARTVADRVIFMDRGEIVEQAAPDEFFAHPKSERTRAFLSQVIH

SEQ ID NO: 12987 - protein, 270 aa, Escherichia coli K12
MKSLFKVTLLATTMAVALHAPITFAAEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 12988 - protein, 406 aa, Escherichia coli K12
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEAGVMVLNAGPDVMRFAPSLVVEDADIDEGMQRFAHAVAKVVGA

SEQ ID NO: 12989 - protein, 470 aa, Escherichia coli K12
MIIITEPLLSFVLQKQGIKSPPMDKKMNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAVGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALTLELAGIIFSFMLINLFDSSGTLIGVTDKAGLIDGNGKFPNMNKALYVDSVSSVAGAFIGTSSVTAYIESTSGVAVGGRTGLTAVVVGVMFLLVMFFSPLVAIVPPYATAGALIFVGVLMTSSLARVNWDDFTESVPAFITTVMMPFTFSITEGIALGFMSYCIMKVCTGRWRDLNLCVVVVAALFALKIILVD

SEQ ID NO: 12990 - protein, 440 aa, Escherichia coli K12
MMLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 12991 - protein, 445 aa, Escherichia coli K12
MSHQHTTQTSGQGMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPGYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 12992 - protein, 470 aa, Escherichia coli K12
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKKITIKAP

SEQ ID NO: 12993 - protein, 1016 aa, Escherichia coli K12
  misc_feature (196)..(196): Xaa can be any naturally occurring amino acid
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 12994 - protein, 444 aa, Escherichia coli K12
MGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 12995 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 12996 - protein, 506 aa, Yersinia pseudotuberculosis
MRYAHPGTPEALVSFKAIYGNYIGGEFIEPLGGQYFMNTSPVNGSDIAQFPRSDARDIDAALDAAHQAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDIFPAGVINVVQGYGREAGEALARSKRIAKIAFTGSTPVGRHIMACAAENIIPCTVELGGKSPNIYFADVMEAEPEFIDKAVEGLVLGFFNQGEVCTCPSRALIHESIYAPFMARVMTKVANIRRGDPLDTETMIGAQASRQQFDKILSYIDIARKEGGEILTGGARATITPALDSGFYIQPTLIKGDNLMRCFQEEIFGPVIGVTTFKDEAEALAIANQTQFGLGAGIWTRDAHLAYRMGRGIKAGRVWTNCYHVYPAHAAFGGYKQSGVGRETHKMALNQYQQTKNLLVSYDTAPLGLF

SEQ ID NO: 12997 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 12998 - protein, 203 aa, Nicotiana plumbaginifolia
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLSEIDRYASDSVNKLLVGNKCDLTAQKVVSTETAQAFADEIGIPFMETSAKNATNVEQAFMAMAASIKNRMASQPASNNARPPTVQIRGQPVNQKSGCCLS

SEQ ID NO: 12999 - protein, 221 aa, Lycopersicon esculentum
MEAVFKTQSLFLKLWGLLAVVLAVAVAVKGNSEGDALYALRRSLSDPGNVLQSWDPNLVNPCTWFHVTCNGDNQVTRVDLGNSKLSGHLVPELGKLEHLQYLELYKNNIQGTIPKELGNLKSLISLDLYNNNISGTIPTSLGNLKNLVFLRLNDNKLTGPIPRELTSISSLKVVDVSNNDLCGTIPTSGPFEHIPLNNFEHNPRLEGPELLGLATYDTNCS

SEQ ID NO: 13000 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 13001 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 13002 - protein, 121 aa, Klebsiella sp. LS13-39
IPKRLAVIGASVVALELAQAFARLGSEVTVLARRTLFASDDPAIGEAVTAAFRAEGITVLTQTQASAVTYCDRQFILTTAQGELKVDQLLVATGRTPNTASLNLERAGVTFDSQHRILIDQ

SEQ ID NO: 13003 - protein, 359 aa, Gentiana triflora
MEGGILSNATTVCVTGASGYIGSWLAMRLLERGYTVRATVRDPGNLKKVQHLLELPKASTNLTLLKADLTEEGSFDEAIHGCHGVFHVATPMDFESKDPKNEVIKPTIDGFLSIIRSCVKAKTVKKLVFTSSAGTVDVQEQQKPVYDENDWSDLDFINSTKMTGWMYFVSKILAEKAAWEVTKANDIGFISIIPTLVVGPFITTTFPPSLITALSLITGNEAHYGIIKQGQFVHLDDLCEAHIFLYEHPEAEGRYICSSHDTTIHDLAKMIRQNWPEYYIPTKLKGIDEDIPVVSFSSNKLIDLGFQYKYTLEDMFRGAIDTCKEKRMLPLSIGHQKESTDPEVDEVVKEMELIQDSLD

SEQ ID NO: 13004 - protein, 129 aa, Escherichia coli
LDGNPAITVLHGEARFKDDQSLVVRLNEGGEREVTFDRCLVATGASPAVPPIPGLKESPYWTSTEALVSDTIPARLAVIGSSVVALELAQAFARLGSQVTILARSTLFFREDPAIGEAVTAAFRAEGIE

SEQ ID NO: 13005 - protein, 374 aa, Rhodococcus ruber
MKTKAAVLRGVGQDWRIEEIELGDPVPGEVQVRLVASGMCHSDHHLRTGGSPIPFPVIGGHEGSGIVTKVGPGVTSLVEGDHVVTAFIPACGTCGPCSRGLQNLCDEGAGLLTGRSISDGTYRASAKGEPLVPMCLLGTFSPYITVNEASLVKIEKDIPLEAAALLGCGVATGWGSATAIGGTKVGDTVVVVGVGGVGINAVQGAAAAGARHVIAVDPVEFKRHMALALGATHVYASLEEAMEPVRDLTWGLMADVTVLTVGDIEGDIIQPALTITAKAGQVVVTAMGDATKNEVTLNLFELTLLQKRVQGAIFGGVGPRTQIPALLHHYRSGALKLEELATTVYRLEDVNQGYDDMLAGKNLRGIIRYTDADF

SEQ ID NO: 13006 - protein, 474 aa, Rhodococcus ruber
MTAGHFTELYINGSWVASTSKTVIEVLNPATEEVIGTVPDGTAADVDAAVAAARAAFDGWASTPVDKRAQYLRAIAAGIADRSDELARTISAEMGAPLSFAQAMQVPLPINSFSHAAAVAESFPFERTEGSSVIVREPIGVVGAITPWNYPLHQIAAKVAYALAAGNTIVVKPSEVAPLNAWMLAEIIDAAGVPAGVFNLVSGTGPVVGEALASHHEVDMISFTGSTNAGKRVSELAAQTVKRVALELGGKSANIVLDDADIDELMPNAVQWAMINSGQTCSALTRLLVPRAILTEAETAAKTIAEAYTVGAPDDPDTTLGPLVSATQLKRVRGYIDRGVQEGATLITGGSEPVEGLAVGYYVKPTIFSEVTPDMTIHREEIFGPVLSIAPYDTEEDAVRIANDSEYGLRGGVWSRDVDRARAVAARMRTGQVMINGGEFNPNAPFGGYKQSGTGREFGTHGLEEFLEIKSLQF

SEQ ID NO: 13007 - protein, 450 aa, Hordeum vulgare subsp. vulgare
MAMPPAEKVIVVDANPSKNGHGDEIDDLPVADATSHQIGVDPWYQVAFVLTTGVNSAYVLGYSGSLMVPLGWVGGTVGLLLAAAVSMYANALLGRLHLLGGKRHIRYRDLAGHIYGPKMYRLTWAMQYVNLFMINTGFIIIAGQALKALYLLISNDGAMKLPYCIAVSGFVCALFAFGIPYLSALRIWLGFSTVFSLTYIVAACTLSLKDGMRSPPRDYSIQGDPSSRVFTTIGAAASLVFAYNTGMLPEIQATVRAPVVKNMEKALWFQFTAGCVPLYAIIVIGYWAYGNQTTTYLLNNVHGPVWIKAVANLSAFLQTVIALHIFASPMYEYLDTRFGSKVGGPFAMHNVIFRVGVRGGYLAVNTLMAAMLPFLGDFMSLTGALSTFPLTFVLANHMYLVSNRQRLSSLQKSWHWLNIVFFTILSITAAIAALRLIARDSKEYHIFADV

SEQ ID NO: 13008 - protein, 193 aa, Calamus usitatus
TVVHSGCVAKINPLAPLDKVCVLSCGISTGLGATLNVAKPPKGSTVAIFGLGAVGLAAAEGARIAGASRIIGVDLNPARFDTAKKFGVNEFVNPKDYERPVQQVLAEMTGGGVDRSIECTGNVNVMISAFECVHDGWGIAVLVGVPHKEAVFKTHPINFLNERTLKGTFFGNYKPRTDLPSVVEKYMSKVLEV

SEQ ID NO: 13009 - protein, 193 aa, Phoenix reclinata
TVVHSGCVAKINPLAPLDKVCVLSCGISTGLGATLNVAKPPMGSTVAVFGLGAVGLAAAEGARIAGASRIIGVDRNPTRFDEAKSFGITEFVNPKDYDKPVQEVLAEMTGGGVDRSIECTGNINAMISAFECVHDGWGVAVLVGVPHKEAEFKTHPINFLNERTLKGTFFGNYKPRTDLPLVVEKYMNKELEL

SEQ ID NO: 13010 - protein, 446 aa, Streptomyces antibioticus
MHPVPAPEQPGELIARLRAASRTGRPRSLEWRTEQLTRLRSLLQEHTDALAEALFADLHKSRSEAHAAEIGFTVREIDHLLENLEEWLRPQPAAVPGCPAGSTAYVQYDPLGVVLVIAPWNYPVQLLLVPVAGALAAGNTVVAKPSEVAPACSALLARLIPQYLSRDAVAVVEGGVAETTALLAQRFDHIFYTGNGTVGRIVMRAAAEHLTPVTLELGGKSPVFVDRGTNLADTATRLARAKFANAGQTCVAPDYVLTDPDTARGLVAEIARSVRRMFGSEPELARGYGRIVNLHHFDRVVRLLGSGRIVLGGRHDRENRYIAPTVLADVAAESPVMREEIFGPVLPIVEVPGVDQAISFINDRDKPLAVYGFTAREEVRRRLAEETTSGGLVLGMPMAQVLDPGLPFGGVGESGTGSYRGAHSLAAFSHLKPVLDVPMRPTGPVG

SEQ ID NO: 13011 - protein, 194 aa, Medicago sativa
MASASASLFKSSIVLDKSEWVKGQTLRQSSVSSVRCNPTAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVWTRVWCPLLVPMDESWCPGLDGLASRSAAYYQQGARFAKWRTVVSIP

SEQ ID NO: 13012 - protein, 113 aa, Medicago sativa
GYNGGGGHGGHGGAESVAVQTEEKTNEMNDAKYGGGSYNHGGSYNHGGGSYNHGGGSYHHGGGGYNHGGGGHGGHGGGGHGGHGADQTEDKTQNDQNDIIMHHALFLSNIFHE

SEQ ID NO: 13013 - protein, 106 aa, Castanea sativa
IRHYGRGNGVGFKPDILDMDVMEKVLEVSSEDAVNMARELALKEGLLVGISSGANTIAALRLANMPQNKGKLIVTIHPSFGERYLSSVLFEELRKEAENMQPVSVD

SEQ ID NO: 13014 - protein, 203 aa, Gossypium anomalum
  misc_feature (67)..(67): Xaa can be any naturally occurring amino acid
GYTPLFPRILGHEASGIVESVGEGVNDLKPGDHVLPIFTGECKECRHCLSEESNNMCELLRINCDRXVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 13015 - protein, 203 aa, Gossypium longicalyx
GYTPLFPRILGHEASGIVESVGEGVDDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 13016 - protein, 203 aa, Gossypium bickii
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 13017 - protein, 203 aa, Kokia drynarioides
GYTPLFPRILGHEASGIVESVGEGVDDLKPGDHVLPIFTGECKECRYCLSEESNNMCELLRINCDRGVMLADGKTRFSINGKPIYHFVGTSTFSQYTVVHVGQVAKISPTAPLDKVCPISCGICTGFGATVNVAKPKKGQTVTVFGLGAVGLAAAEGARVCGASRIIAVDLNPRRFEEAKRFGITEFVNPKDYDKPVQEVIVE

SEQ ID NO: 13018 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 13019 - protein, 1034 aa, Sinorhizobium meliloti 1021
  misc_feature (205)..(205): Xaa can be any naturally occurring amino acid
MEAVPMNVDLSRRSFLKLAGAGAAATSLGAMGFGEAEAAVVAHVRPHKLTTTTETRNTCPYCSVACGVIIYSKGDLRKGEAADIIHIEGDADHPTNRGTLCPKGAALKDFVKSPTRLQYPMHRKPGSDKFERISWEDAFDRIARLMKDDRDANFIAANAAGVPVNRWTTVGMLAASATTNETAWATFKFAKALGIVGFDNQARVXHGPTVSSLGPTFGRGAMTNSWTDIKNTDLVVVMGGNAAEAHPCGFKWVTEAKATRGAKLIVVDPRYTRTASVSDYYAPIRQGTDIAFLNGVMKYCIDNDKVQWDYMKAFTNASYLVKDGFGYQDGLFTGYDAEKRDYDKSTWDYVLGDDGFVVTDPALQHPRCVWNLLKAHLAPYTPEMVERICGTPKDKFLKVAEMISECSSPTKTMTSMYALGWTQHSSGSQNIRAMAMLQLILGNIGVRGGGMNALRGHSNIQGLTDLGLMSHLLTGYLTMPTEKDVDFTTYMSTRQFKPLRPGQTSYWQNYRKFMVSFQKAMWGDAARIDNDWAFNYLSKLDVPAYDVLRVFELMYAGKVNGYICQGFNPLLAFPNRDKNTKALSNLKWLVTMDPLDTETARFWENHGDFNPVDTASIQTEVFQLPTTCFAEEEGSLTNSGRWLQWHWAGGTPPGEAKHDTYIVAQIFLRMKEMYRNEGGAFPDPILNLSWDYADPNEPTPEELAKEINGRALTDLMDPANPMKVQVAAGKQILNFSQLRDDGSTMCGCWIYSGNFNEQGNNMARRDNHDPDDTGAYLGWSFAWPLNRRTLYNRASADLQGKPWDPSRKLLEWDGTKWAGYDVPDIAPTAKPDEIGPFIMNQEGTARLFSRGLMRDGPFPAHMEPFESPVANVFNPKMRGNPVSRVFQTDVAQMGLSDEFPYAATSYRLTEHFHYWTKHNRVNSALQPEFFVEISEELAEEKNIENGGWVRVWSKRGSVKAKAVVTKRIRPLMCDGKPVHVVGIPLHWGFTGSAKKGLGPNSLAPFVGDANIETPEYKAFLVNIEPSTAPEEATV

SEQ ID NO: 13020 - protein, 307 aa, Sinorhizobium meliloti 1021
MPEPGPHEVRIRVKALGLNRAEALLRSGAYIETATFPSGLGLEAAGFVEKVGPGVQGFIPGDPVSVLPPKSMIRWPAYGELAIFPAALLVRHPPSLSFEEAAAVWMQYLTAYGGLVDIGGLRRGDFVAITAASSSVGLAAIQIANMVGAIPVAVTRTSAKRQGLLEAGAAHVIASMEEDLEAQLKRVSGQHGIRVVFDPVGGPIFEPLAAAMAWGGILVEYGGLSPEKTPFPLFAVLSKSLTLRGYLVHELLADPGRLERAKAFILDGLVSGALRPIIARAFPFDQIVEAHRFLESNEQFGKIVVTV

SEQ ID NO: 13021 - protein, 318 aa, Sinorhizobium meliloti 1021
MHSTCPLNWWRCSVTDDPYQILGVPRTGKPDEIRKAYRKRAKELHPDLHPGDKEVETKFKALSAAYHLLSDPEQRARFDRGEIDASGAERPQQHFYRHYADADHARRYGSAGGTGEFEDVSDIFADLFGQGGAGGRFKARGQDRHYHLELEFLDAVNGARRRITFPDGNTLDLAIPAGTRDGSTLRLRGKGTPGIAGGEPGDALIEISVRSHSVFRREGNDIEIDLPITLYEAVLGAKIEVPTISGRVSMTIPKGSNTGDILRLRGKGVKSQHGPAGDQRVTLKVVLPTATDPDLERFMETWRRSHAYDPREALGRAT

SEQ ID NO: 13022 - protein, 508 aa, Sinorhizobium meliloti 1021
MSNHLFDAIRRAARPDSAFILTADGRVWTYGDMLEHSGRIASVLDALGVRPGDRVAVQVEKSPEALMLYLACLRTGAVYLPLNTAYTLAELDYFFGDAEPRLIVCAPGAKEGIAKHAADCGAEVETLDEKGGGSLIDLARGKAPDFPDADRGPDDLAAILYTSGTTGRSKGAMLTHDNLLSNATTLREYWRFTADDRLIHALPIFHTHGLFVASNVILLAGASMFFLPKFDANEVLRLMPQSTSMMGVPTFYVRLVQNPGLTHEATAGMRLFVSGSAPLLAETHRTFAQMTGHAILERYGMTETNMNTSNPYDGERIAGTVGFPLPGVSLRVADPESGRPLPKGETGMIEVKGPNVFKGYWRMPEKTQGEFRADGFFITGDLGRIDERGYVHIVGRGKDLVISGGYNIYPKEVETEIDQMPGVVETAVIGLPHPDFGEGVTAVVVRKPGAAIDERAILDGLEGRLARYKQPKRVIFVDDLPRNTMGKVQKNVLRETYARLYAGAEARV

SEQ ID NO: 13023 - protein, 504 aa, Sinorhizobium meliloti 1021
MLSNFIAPDSNDPRLRIKSRYQMLVDGKSVDAASGSTIDRVSPGHAGEVVGTWPEASADDVRKAVAAARKAFDAGPWPRMSGAERSRLMFKVADLILARQEELALIESLEVGKPIAQARGEIGFCADLWSYAAGQARALEGQTHNNIGDDRLGLVLREPVGVVGIITPWNFPFIIASERVPWAIGSGCTVVLKPSEFTSGTSIRLAELAREAGIPDGVFNVVTGYGDPAGQVLAEDPNVDMVAFTGSVRVGTKLGEIAARTVKRVGLELGGKGPQIVFADADLDAAADGIAYGVYHNAGQCCISGSRLLVQEGIRDALMERLLDISRKVAFGDPLNERTKIGAMISEAHAEKVHSYVTAGITSGAELLLGGERIGREAGLYYAPTVFAGVTPDMSIAREEIFGPVLSTLTFKTADEAVALANATEFGLSASVWSTNLETALQTIRRIRAGRCWINSVIDGTPELPIGGYKKSGLGRELGRYGFDEYSQFKGVHVTLGRPAPWFT

SEQ ID NO: 13024 - protein, 293 aa, Sinorhizobium meliloti 1021
MSGKTKIAFLGTGLMGAPMARRLLGAGFSVTVWNRDAAKAEPLAADGADIAASPADAVAGAAIVFTMLTNGQAVSEVLFERGVADSLAEGRIVVDCSSIAPQIAREHARRLAEKGIRHLDAPVSGGVVGAAAGTLAIMAGGDGAAVESLKEVFAVLGRVTHVGPSGAGQVCKLANQQIVAVTIGAVAEAMVLVEAGGASRAAFRDAIRGGFAESRILELHGARMVERNFAPGGASNNQLKDLNAVMAMADELSLELPLTRQVRQEFADFVESGGGEQDHSGLLLQLEKLNPRN

SEQ ID NO: 13025 - protein, 487 aa, Sinorhizobium meliloti 1021
MTFHAKFSGYADPALHAAGLYIGGKWQSGSGITVLDPSTGNLLAEVADASIEDAQRAVDAADAAAAGWRATPARQRSEILRRWYQLMTQHAEELATLIALENGKALADARGEVAYAAEFFRWYAEEATRIPGEFRHTPSGSHNILVDHEPIGIAVLITPWNFPAAMATRKIGPALAAGCTVILKPASETPLTAYAMARLGEEAGVPPGVVNVLTTSNPGGITNAMLADPRVRKLSFTGSTGVGRVLLAEAAKSVVSCSMELGGNAPFIVFDDADLEVALDGAMIAKMRNAGEACTAANRFYVQAGIHDAFVAGLTARMKSLKLGPGYDPETQCGPMITQNAVRKIDRLVSEALAAGARATTGGKPLTENGYFYPPTVLENVPVNASIAREEIFGPVAPVYKFESDDEAIRLANNTEYGLAAYIYSRDLKRAMKVGKRIETGMLGINRGLMSDPAAPFGGVKQSGLGREGGVTGILEFMEPKYFAVDY

SEQ ID NO: 13026 - protein, 295 aa, Sinorhizobium meliloti 1021
MTNRVALIGAGAMGGSIGARLVETGNRLTVFDPGPDKVQALVDKGAFAAPSAAEAAAVSDYVILSLNAPAIVRQAVFGDAGVAAGAQAGTLIIDMSSIDPNATKQLAADAAEKGLRWVDSPLSGGAPKALIGELTLMAGGTAQDVKDAHAVLRHVASNYTHMGSVGAGQTTKLINQVLCGLGFLAVAEATQLALDAGVDASKIPQALMGGRADSAILQEYMPRFVTKDYRHTGRIDNMVKDLAGAQDLARRTNTAMPLTAACAEIHRMLTAAGLGGEDQAALMEFFRGPNKENFK

SEQ ID NO: 13027 - protein, 329 aa, Sinorhizobium meliloti 1021
MQKRKLGQGLEVSALSLGCMGYGKARDIPDRPQMIELLRRAVDLGMDFFDTAEVYGPWTNEEMVGEAFAGMRDKVKIATKFGWDIDQSTGEHGGGVNSKPTQIRSAVEGSLKRLRTDFIDLLYQHRVDPDVPMEDVAGTVKDLIAEGKVRYFGLSEAGAESIRRAHAVQPVAALQSEYSLWTREPEAEIIPTLEELGIGLVPFSPLGKGFLAGKIDASTAFAANDFRSQIPRFAPEAREANQALVDLIRSVGERRSATPAQVALAWLMAQKPWIVPLFGTRKLERLEENLGALSVTLSDDDLEQIESGAAAIRIEGARYPEEMLRRSGR

SEQ ID NO: 13028 - protein, 232 aa, Sinorhizobium meliloti 1021
MFKKLCAEFLGTCWLVLGGCGSAVLASAFPQVGIGLLGVSFAFGLTVLTMAYTVGGISGGHFNPAVSLGLAVAGRVPAASLVSYVIAQVAGAIIAAAVLYVIATGKADFQLGSFAANGYGEHSPGGYSLTAALVTEVVMTFFFLIIILGSTHRRVPAGFAPIAIGLALTLIHLVSIPVTNTSVNPARSTGQALFVGGWALSQLWLFWIAPLFGAAIAGIVWKSVGEEFRPVD

SEQ ID NO: 13029 - protein, 487 aa, Sinorhizobium meliloti 1021
MQRFQCYINGEFADGEARFESIDPTTGRAWAEMPEAREADVNRAVEAARIALHDQPWSTLTATQRGKLLYKLADLVAENAGRLAELETRDTGKIIRETSSQIAYVADYYRYYAGIADKIEGSYLPIDKPDMDVWLRREPIGVVAMVVPWNSQLFLSAVKIGPALAAGCTMVVKASEDGPAPLLEFARLVHAAGFPAGVVNIVTGFGPSCGAALSRHPQVDHIAFTGGPETARHIVRNSAENLASTSLELGGKSPFIVFADADLESAANAQIAGIFAATGQSCVAGSRLIVEKSVKDRFLQILKAKAETIRIGSPLEMSTEVGPLATERQSNHVKTLVARSLAAGAKLVTGGTAPEGAGFYYRPTILDCDGSASPSLENEFFGPVLSVLSFETEAEALHLANDSRFGLAAGVFTQNLTRAHRLMKGIRAGIVWVNTYRAVSPVAPFGGFGLSGHGREGGLEAALDYTRSKTVWLRTSDDPIPDPFVMR

SEQ ID NO: 13030 - protein, 490 aa, Sinorhizobium meliloti 1021
MTISETLLVKLKDPSLAVDKGLIGAEWLDRSDSGKTFDVSNPATGEVIAILPDMSRSETARAIDAAHAAQRAWAEKTGKERAAVLRNLYDLVVANADDLATILTMEMGKPLTEAKGEILYGASYVEWFGEEAKRVYGDTIPGHQPDKRIIVLKQPIGVVAAITPWNFPNAMLARKLAPAAAAGCAVVSKPAAETPLSALALALLAERAGLPAGVFNVILSTDSAEVGKEMCANDKVRKLTFTGSTNVGKILMRQGADQIMKLGLELGGNAPFIVFDDADLDAAVEGAMVAKYRNNGQTCVCANRIFVQAGIYDAFAARLTAKVSEMTIGDGFEPDVDAGPLISEKALAKVEEHIRDAVTKGADLVLGGNARGGLFFEPTVLTGATMDMKIAGEETFGPVAPLFKFETENEVVSMANKTEFGLASYFYSKDVSKVFRVAEALEYGMVGINTGLISTEVAPFGGVKQSGQGREGSKYGIDDYVETKYLCLSI

SEQ ID NO: 13031 - protein, 453 aa, Sinorhizobium meliloti 1021
MLVQATNRLRQASARSRSKHLFDRAKGVFTDGTTRASVERDPFPIYAQRGEGAYLVDVDGNRLLDLNNNFTTLIHGHGFAHVSEAVVDLLRLGTCFANPTEHEIALAELLTARIPAMERVRFVNSGTEAVMFAIKAARAFTARPAIARIEGAYHGAYDWAEAGQGVSPGKDGWDPIPIPTPTYRGTPSSVADEVHLLRFNDVEGLERRLSAASDRIACVLIDPMPSRAGLLHPEPTFIEALSETAHKYGILIVADEVLNLRQGYAGASPRYGLKPDLVTAGKIIGGGFPIGAIGGREEVMRVFGTENARPLLPQGGTFSANPVSMAAGLAAMEAMTPDAFDRLEAMGERLRAGLRASIASRDARFSVTGAASLFRIHPKRVAPLEYRDAHLSAEEAWIMRTMSRYFLEAGILLPYGAAACLSTPMVHSDIDRILSAFDEFLEAKIGPEKERAK

SEQ ID NO: 13032 - protein, 340 aa, Sinorhizobium meliloti 1021
MTMTAAVVREFGKPLVIEEVPVPQPGPGQVLIKYEATGVCHTDLHAAKGDWPVRPNPPFIPGHEGVGYVAKLGAEVTRLKEGDRVGVPWLHTACGCCTPCRTGWETLCGSQQNTGYSVDGTFAQYGLADPDFVGRLPARLEFGPAAPVLCAGVTVYKGLKETEVRPGEWVLVSGIGGLGHMAVQYAKAMGMHVAAADIFPDKLALAEKLGADLVVDARAPDAVEEVQRRTGGLHGALVTAVSPKAMEQAYSMLRSKGTMALVGLPPGQICLPVFDTVLKRITVRGSIVGTRQDLEEALEFAGEGKVAAHFSWDKIENINAIFERMEEGKIDGRIVLDLNG

SEQ ID NO: 13033 - protein, 498 aa, Sinorhizobium meliloti 1021
MDQLNNFLSPPAAPRDFGFFVDGKWQSGHDFFVRHSPGHGVAVTRTAKCSVDDLNAAVAAARRAFEDRRWSGLPGGSRASVLLRVAEILRTRRDELAYWETLENGKPIAQARGEIDHCIACFEVGAGAARLLHGDSFNSLGDGLFGMVLREPIGVVGLITPWNFPFLILCERVPFILASGCTMVVKPSEVTSATTLILAEVLAEAGLPDGVYNVITGSGRTIGQAMSEHPDIDMLSFTGSTAVGRSCVHAAADSNFKKLGLELGGKNPIIVFADSDLEDAADGAAFGISFNTGQCCVSSSRLIVERSVAREFEALLAEKMKRIRVGDPLDETTQVGAITTEAQNTTILDYIAKGKTEGAELVTGGTAIDLGRGQYIAPTLFSGVSREMAIARDEIFGPVLCSMTFDTVEQAVELANDTVYGLAASVWTKNIDKALTVTRRVRAGRFWVNTMMAGGPEMPLGGFKQSGWGREAGMYGVEEYTQVKSVHVEIGKRTHWIS

SEQ ID NO: 13034 - protein, 450 aa, Sinorhizobium meliloti 1021
MLIAAARQLEKGRMTTITVDDALDRAGTGTYQRRLMAIFGLVWAADAMQVLAVGFTAASIAATFGLTVPQALQTGTLFFLGMLFGAAGFGRLADRIGRRRVLIATVACDAVFGLLSVFAQDFTVLLLLRFLTGAAVGGTLPVDYAMMAEFLPARNRGRWLVMLEGFWAVGTLIVALAAWAASLAGVADAWRYIFAVTAIPALIGVGLRFLVPESPLYLLRLGKTSEAKAIVDEILVVNGKMRLGAGASLVPPPPTASAGIFSADLRKRSLMILAIWFLVSISYYGVFTWMPPRLAGEGFGFVRGYGFLVVLALAQIPGYALAAYGVEKWGRRPTLIGFCLLSALGCLLFVAAGTAMLIGVSLLIMSFALLGTWGALYAYTPELYPTASRATGMGAAGAMARLGGLLAPSLMGLVVAQSFGLAIGIFAGLLLVAAVAAFLIDAETRRVSLA

SEQ ID NO: 13035 - protein, 363 aa, Sinorhizobium meliloti 1021
MEIPMNPMFTSVRVGRYMLPNRLVMAPMTRSRAAFDGTPGELATEYYVQRARLGLIVTEGTQPSDDGQGYLTTPGIYTPAHIAGWRKITSAVHDKGGHIFIQLMHAGRMSHPDNTPHHRQGVAPSAIAPGAGMFTATGMQDIPTPRALTTEEVRRTVAEFSHAARSAIEAGADGIEIHGANAYLVQQFFAPSANTRTDEYGGSIENRARFAIEVATAIAEEVGADRTAIRLSPGTALWGIDEGAEGPDLYRYLVAELDKLGLAYVHILHQSNEPLLADIRKLWRQPLILNRPGRPRGQIGADVASGLADLEAFGQMVLANPDFVARLKADAAMNESDPKTFYGGAAKGYIDYPVLSARTDTSS

SEQ ID NO: 13036 - protein, 475 aa, Sinorhizobium meliloti 1021
MMFKMGRNTMNYQSKVAGDPASPEKPGPGGAIDRLFEVTRSGSTIRTEIIAALTTFLAASYVIVVNPAILQNAGIPFSGGVTATVLVSFIGSCAMGLYARSPILVAPGMGINALFAYTMVMGAKVPLEIALGCVFWAGVLFTILAILNLRTAVIEAVPKDLRYGIACGIGLFIALIGLENAKFIVASPDTIVALTQFTPVTLTFIAGFIITAALVVRRIPGAMMTGMIITTVLAIPIGRLWGDGSAFAGGTPDVQTLVNWSGLFAAPDFSFVGRIDLLGALQVAYAPFIFVFLFTNFVEALSTFLGLAEAANLKDESGMPRNIKESMHVDAVAALISAPLGTSPATVYLESGAGIAQGGRTGLVAFIAGLLFLPFLFLSPLLSLVPTIATAPVLILTGLFMSAPMGQINWADMEDAIPAFLAIVLIPLTFSITLGLSLAIIAFVMMKLALGKVSEVKPVMWFVAVLAAMLVMQVQ

SEQ ID NO: 13037 - protein, 489 aa, Sinorhizobium meliloti 1021
MQSYQIREMATPLCQPAASHFIDGTFIEDRTGPEILSVNPVDGEIIAKLHGATSCIIEKAIASAKRAQKEWARKEPAERGRVLSRAADIMRARNRELSVLETRDTGKPISETLVADAASGADCLEYFGAIAATLSGDSIQFGEDWVYTRREPLGVCLGIGAWNYPIQIAAWKAAPALACGNAMIFKPSEVTPLSALKLAEILTEAGLPPGVFNIVQGAGDVGAELATHPAIAKVSLTGSVKTGARVASAAMAGIRPVTMELGGKSALIVFDDADVEAAVSGAILGNFYSAGQICSNGTRVFLQRGIREAFLARLLARVAALKIGDPMDEETDIGPLVSAAHRNRVATYVARAEVEGAYQMAPPRKLPPGDAWHEPVVFTNVTDWMTLAREEVFGPVMAVLDFDDEQDVVARANATDFGLAAGIFTRDLVRAHRLAAELEAGTVWINAYNLTPAGMAFGGIKRSGIGRENGRVAIDHYTQLKSVFVSMQT

SEQ ID NO: 13038 - protein, 438 aa, Sinorhizobium meliloti 1021
MSMVNAFSREDFERLDKAERALIARREKVLGPAYRLFYEKPLHLVRGEGVFLYDAAGERYLDAYNNVSSVGHCHPRVVEAITRQTAVLNTHTRYLHEGIVDYAEALTATFPEALSQAMFTCTGSEANDLAVRIARFVTGGTGIIATELAYHGLTSAVAEFSPSLGESVTLGPHVRTVSAPDSYRHSPEEIMEKFGRDVRAAIADLKRHGIKPAMLITDTIFSSDGIFDGPRGFLKPAVDAIHEAGGLFVADEVQPGFGRTGETMWGFERHGVAPDIVTIGKPMGNGYPMAGIVLRPEVIAEFGPRARYFNTFGGNPVAAAAGKAVLDTIRTEGLQQNALVVGRHIMERVKSLSAIHPAIGNVRGSGLFIGVEIVADSTIKRPDAALTTRIVNGLRERRILISASGPNANVLKIRPPLIFSRENADMLVDALGNVLKTL

SEQ ID NO: 13039 - protein, 487 aa, Sinorhizobium meliloti 1021
MTLSFDPDTLPLPVGHFIDGRLVPAEGIIDMHRPSDGKPYAGCPLADEVLVDRAVETAKKALKATNWSGVRPRERTVVLQRWADLIESEAETLAKLEALSSTRPVGHLVAGDIAVSAEQIRFFAEFADKEGSDLVPTDDSNLGMIMTEPYGVVGAITPWNFPVSMAAWKLGPALAAGNAVVLKPSEMTPFSTVYLAELAIRAGLPAGLINIVLGDGPVTGTAMTGHPDIAKVSFTGSTGAGTAIMTNVACTGIKPMTLELGGKSPQLVFADADLDKAAAAIAQSMLSNAGQACVAGSRLIVEECIAAPLAEAIVTRMEAAKPGPTWDETSEYSPIISKRQLNRIHGIVEAAVEAGGECLFGGAQMDAPGYFYQPTLMAVRDSSSPAITEEIFGPVLTMQTFADEEEALALADHPTYGLAAGLFTRDLSRALGLTRRLQAGTVWVNRYSRSRDHILPTGGYKRSGIGKDLGREAYHANRKSKSVLISL

SEQ ID NO: 13040 - protein, 484 aa, Sinorhizobium meliloti 1021
MRLKDRELFRQLGLIGGEWIAGASGVVVDVIDPANQAVLGTVPDMGTAETRAAIEAANAAFGPWKKKTHAERAAVLERWHALMIENLEDLAVLVTMEQGKPLEEARGEIRYGAAFVKWFAEESRRIGGHTIPSPTSDRRIVVLKEAVGVCAIVTPWNFPNAMITRKVAPALAAGCTVVIKPSEFTPFSALALGVLAERAGIPAGVVNIVTGMPTAIGNEFMTNETVRKISFTGSTRVGSLLMRGAADSVKRLSLELGGNAPFIVFDDANLDLAVEGAIASKFRNGGQTCVCANRILVQAGVYDAFAEKLGARVNAMKVGPGTEPGIAIGPMINEAAIDKIDRHVEDAIAKGAKLAARGRSVPEGRQYTAPIVLTGATTDMLLASEETFGPVAPLFRFETEDEAIAIANGTPFGLAAYFYTEGLKRSWRVAEALEFGMIGLNTGAISTEVAPFGGVKQSGLGREGAQVGIEEYLEMKSFHIGGLD

SEQ ID NO: 13041 - protein, 458 aa, Sinorhizobium meliloti 1021
MYSNSLIELDRAHLIHPVASYRGHEKLGVRVLASAKGATVTDASGRQLIDGFAGLWCVNAGYGQETIVEAAAKQMRELSYATAYFGLGSEPAIRLASELAERAPGNLNHVYFTLGGSDAVDSTIRFIRYYWTARGEPQRDQFISVEQGYHGSSTVGAGLTALPAFHTGFGIPFDWQHKIPSHYAYRNPVGDDPQAIIAASLTALRRKVEEIGPERVAAFYAEPIQGSGGVLVPPRGWMKAMRELCRDLGILFVADEVITGFGRTGPLFASTENEIVPDFITTAKGLTSGYVPMGAVFMADHIYQTIADGAGASAVGHGYTYSAHPVSAAVGLEVLRLYENGLLENGVKAGARLMEGLGSLRDHPLVGDVRGRGMLAAIELVVDKAQKTPLPAAAEPARRIFDRAWENGLVIRAFANGVLGYAPPLCCSETEIDAIIERTRQSLDETLEDPDVRRALKT

SEQ ID NO: 13042 - protein, 375 aa, Sinorhizobium meliloti 1021
MDARAAVAIQAGKPLEVMTVQLEGPRAGEVLVEVKATGICHTDDFTLSGADPEGLFPAILGHEGAGIVIDVGPGVTSVKKGDHVIPLYTPECRACPSCLSRKTNLCTAIRATQGQGVMPDGTSRFSLNGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTRVMRQALEASHRGWGKSVIIGVAGAGQEIATRPFQLVTGRTWMGTAFGGARGRTDVPKIVDWYMEGKIAIDPMITHTMPLDDINKGFELMHSGESIRSVVLF

SEQ ID NO: 13043 - protein, 324 aa, Sinorhizobium meliloti 1021
MRRDRIVKPKVIVTRRWPTEVEDRLTAEFDTRLNETDQPYDRRELRAALEEADAVLPTVTDKISADMLEGGIRAKILGNFGVGFNHIDTAAATKVGLVVTNTPGVLTDATADLAMTLLLMCARRAGEGERELRAGKWTGWRPTHLCGSHVTGKTVGIIGMGRIGQAVARRCHFGFGMDVVFFDSHSIAGLDVPARQLPSVDDVLATADFVSLHCPGGGENYHLIDDDRLACMKWSAFLINTARGDVVDEHALVRALETRRIAGAGLDVFEGEPRVPGRLAERQDVVLLPHLGSATKETRVAMGMRVIENLKAFFSGRSPPDAVC

SEQ ID NO: 13044 - protein, 494 aa, Sinorhizobium meliloti 1021
MQNLPKLSMYIDGQWVAPASGEYIETVDPFTARPWALVPRGNAEDADRAVRAAHRAFSQGPWGKMHPTERGRIIQRFAALIEEHADALADIEVRDNGRLLAEMTHQIRYIPRWYHYYAGFADKIEGTLHPCDKPALSFSRHEPLGVCVGIVPWNAPLLLFSLKAAPALAAGNTLVMKPAEFTSATALKLMELVEKAGFPTGVINVVTGYGPEVGEPLVTHPLTRHVGFTGSTKTGAHLYSLAAKDVKRVSLELGGKSPNIVFGDADLDNAVRGVVGGIFGAVGQTCIAGSRLLVHRSIHDEFLEKLAVFTKTARIGDPRKVETQIGPIANSMQFEKVLGYIDIARREGAELILGGGRPDLEECGTGYFIEPTIFAGVSNDMRIAREEVFGPVLSAIVFDEPEEALAIANDSEFGLGAGVWTSDMRLALKMSERLEAGSVWVNTYRDISYTTPFGGYKKSGIGRENGVAGIYEYLQTKAVWLSTAEEIANPFVIG

SEQ ID NO: 13045 - protein, 370 aa, Sinorhizobium meliloti 1021
MNAPAIIPSPVFTGTSLKGLDFANRLSVAPMTRISASCAGVPGERMVRYYQRFARGGFSLVMSEGIYTDKAYAQTYSGQPGLTDREQADAWRRAVDAVHAAGGSIFAQLMHGGALSQGNPYRSDTIGPSAIRPKGSQMTGYRGDGPYAMPREISEAEIAAAIEGFAGAARLAIEVAGFDGIEIHGANGYLLDQFFTDYTNHRQDRWGGDIVARFGLSLEVLKAVRAAIGPSVPLGLRLSQGKVNDFRHKWAEREQGAARVFEALAESPADFAHVTEFEAWRPAFEGGEISLVSLARRHAPRLFLIANGSLHELARAEQVMESGADMIALGRGALVNPDWPHLTAARSALRPFELSMLAPISDIKDSELAL

SEQ ID NO: 13046 - protein, 470 aa, Sinorhizobium meliloti 1021
MPADLAARTSSKIFNGVDLMDASARADNAFYLDRQERRESNARSYPRRFPVALKSASGCIVTDVDGRSYLDCLAGAGTLALGHNHPEVIETLQQVLGSGLPLHTLDLTTPVKDRFVSDIFGTLPAGLRDEAKIQFCSPSGTDAVEAAIKLAKTATGRTDLVSFRGAYHGMSQGSLSLMGSLGPKASVGQLVPGAHFFPYPYAYRCPFGRGGNETATLAAEYFERALRDPEGGINRPAAVILEAVQGEGGVIPAPVEWLRAVRRVTRDLGIPLIVDEVQSGVGRTGSFYAFQKAGIIPDVVVLSKAIGGGLPLAVVIYREDLDLWKPGAHAGTFRGNQLAMAAGSKTLEIIERERLVERAAIAGRRLRANLERIAAQTPYIGEVRGEGLMLGVEVVDPEGLPDALGHPPHGQEIARMIQHEMFRAGIILETGGRFGSVLRLLPPLVISDAEIDQVSGALAAAFERLGRKAA

SEQ ID NO: 13047 - protein, 322 aa, Sinorhizobium meliloti 1021
MKAVVMKEVGGTDVMEFVDRPEPVARPAHVVVEVAAAGVNFMDIGVRQGMAWTDIPNPKVLGVEGAGRVLAVGDGTGEFAVGDRVAWVYAPGSYAQRQSIPAASLVKIPDTVDDRTAASTMMQGLTASHFATDFYPVQPGDIALVHAAAGGVGLLLTQIIRLRGGRVIGRVSSEDKVAIARKAGAEHVIVDTDGRFADEVLRLTGGEGVNVVYDGSGPKTFKGSIEALRRSGTFCWYGPVLGGPGPLEIMNLPKSIKIGYATFMDHIHTRELLLDRTKQLFDWIEDGSITVTIGETYRLADAAGAHAAMASRATTGKLLLIP

SEQ ID NO: 13048 - protein, 404 aa, Haemophilus influenzae Rd KW20
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 13049 - protein, 120 aa, Escherichia coli
ISYIHAEAYAAGELKHGPLALIDADMPVIVVAPNNELLEKLKSNIEEVRARGGQLYVFADQDAGFVSSDNMHIIEMPHVEEVIAPIFYTVPLQLLAYHVALIKGTDVDQPRNLAKSVTVE

SEQ ID NO: 13050 - protein, 219 aa, Medicago truncatula
  misc_feature (195)..(195): Xaa can be any naturally occurring amino acid
ENNIAMARRRGYHIAMTTSLSSDVPVGYFSWAEYDIMAPISPKTEKAFAAAFISNCGARNFRLQALEALEKTNISIDSYGSCHRNRDGRVDKLETLTRYKFSLAFENSNEEDYVTEKFFQSLVAGTIPVVVGPPNIQDFAPSPGSFLYIKELEDVESVAKSMRYLAENPEAYNQSLRWKYEGPSDSFKALVDMAXVHSSCRLCIHLASKSREKEEKSPD

SEQ ID NO: 13051 - protein, 165 aa, Prunus persica
  misc_feature (101)..(101): Xaa can be any naturally occurring amino acid
  misc_feature (134)..(134): Xaa can be any naturally occurring amino acid
WAFGGMIFVLVYCTAGISGGHINPAVTFGLFLAREVSLIRAVAYIVAQSLGAIVGVGLVKAFQKHNYNSQGGGANTVAPGYSKGTALGAEIIGTFVLVYTXFSATDPKRSARDSHVPVLAPLPIGFAVFIVHLXTIPITGTGINPARSFGPAVIFNNEKAWDDHW

SEQ ID NO: 13052 - protein, 165 aa, Prunus persica
WAFGGMIFVLVYCTAGISGGHINPAVTFGLFLARKVSLPRAVLYIVAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDRW

SEQ ID NO: 13053 - protein, 165 aa, Prunus persica
WAFGGMIFVLVYCTAGISGGHINPAVTFGLFLARKVSLARAILYMVAQSLGAICGVGLVKAFQNAYFTKYGGGANGLADGYSQGTGLAAEIIGTFVLVYTVFSATDPKRNARDSHVPVLAPLPIGFAVFIVHLATIPITGTGINPARSLGAAVIYNNDKAWDDHW

SEQ ID NO: 13054 - protein, 143 aa, Salmonella enterica
FMPKPMFGDNGSGMHCHMSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 13055 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 13056 - protein, 148 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 13057 - protein, 147 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 13058 - protein, 146 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13059 - protein, 137 aa, Salmonella enterica
ATFMPKPMFGDNGSGMHGHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 13060 - protein, 145 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 13061 - protein, 142 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 13062 - protein, 144 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 13063 - protein, 143 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13064 - protein, 154 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLAAKNLYDLPP

SEQ ID NO: 13065 - protein, 141 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13066 - protein, 144 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13067 - protein, 143 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 13068 - protein, 145 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 13069 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 13070 - protein, 148 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 13071 - protein, 145 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13072 - protein, 143 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 13073 - protein, 150 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPN

SEQ ID NO: 13074 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVESRKARRIEVRFPDPAGNPYLCFAALLMAGLDGIKNKIHPGEAMDKNLYDLP

SEQ ID NO: 13075 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRMEVRFPDPAANPYLCFAALLMAGLDGIKNKIHPGEAMDKNLYDLP

SEQ ID NO: 13076 - protein, 144 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 13077 - protein, 142 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 13078 - protein, 142 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13079 - protein, 366 aa, Arabidopsis thaliana
MAVKKACEMFPKSLIEDVHKWGCMKQTGVSLRYMMEFGSKPTERNLLISAQFLHKELPIRVARRAIELQTLPYGLSDKPAVLKVRDWYLESFRDMRAFPEIKDSGDEKDFTQMIKAVKVRHNNVVPMMALGVNQLKKGMNSGNLDEIHQFLDRFYLSRIGIRMLIGQHVELHNPNPPLHTVGYIHTKMSPMEVARNASEDARSICFREYGSAPEINIYGDPSFTFPYVPTHLHLMMYELVKNSLRAVQERFVDSDRVAPPIRIIVADGIEDVTIKVSDEGGGIARSGLPRIFTYLYSTARNPLEEDVDLGIADVPVTMAGYGYGLPISRLYARYFGGDLQIISMEGYGTDAYLHLSRLGDSQEPLP

SEQ ID NO: 13080 - protein, 464 aa, Alnus firma
GFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAGKWSPELAAACEVWKEIKFEFPAMDTL

SEQ ID NO: 13081 - protein, 464 aa, Fagus crenata
GFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13082 - protein, 464 aa, Quercus phillyraeoides
GFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFIFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 13083 - protein, 464 aa, Quercus miyagii
GFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 13084 - protein, 464 aa, Quercus hondae
GFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 13085 - protein, 319 aa, Solanum nigrum
MGSKYSKATNSINDASNSSYRVPFESLRVPFVDLQEATNNFDDKFLIGWGVFGKVYMGVLRNGTKVALKKHMPESSQGIEEFRTEIEILSLCSHPHLVSLIGYCDERNEMILIYEYMENGNLRSHLYGSDLPAMSWEQRLEICIGAARGLHYLHTSAVIHRDVKSINILLDDNFVPKITDFGLSKTGTELDQTHVSTAVKGTVGYLDPEYFIRGQLTEKSDVYSFGVVLFEVLCARPAIAHSHSREMISLAEWAVESHNNGQLEQIIAPNIAAKIRPESLKKFGETVVKCLALSSEDRPSMGDVLWKLEYALRLQESVI

SEQ ID NO: 13086 - protein, 181 aa, Synechocystis sp. PCC 6803 [sequence omitted]

SEQ ID NO: 13087 - protein, 275 aa, Synechocystis sp. PCC 6803
MANQDLIPVVVNGAAGKMGREVIKAVAQAPDLQLVGAVDHNPSLQGQDIGEVVGIAPLEVPVLADLQSVLVLATQEKIQGVMVDFTHPSGVYDNVRSAIAYGVRPVVGTTGLSEQQIQDLGDFAEKASTGCLIAPNFAIGVLLMQQAAVQACQYFDHVEIIELHHNQKADAPSGTAIKTAQMLAEMGKTFNPPAVEEKETIAGAKGGLGPGQIPIHSIRLPGLIAHQEVLFGSPGQLYTIRHDTTDRACYMPGVLLGIRKVVELKGLVYGLEKLL

SEQ ID NO: 13088 - protein, 325 aa, Synechocystis sp. PCC 6803
MDIKHGFVDSIGHTPLIRLNSFSDETGCEILGKAEFMNPGGSVKDRAALGIIETAEKEGKLKPGGTVVEGTAGNTGIGLAHICNAKGYKCLIVIPDTQSQEKIDLLRTLGAEVRTVPAVPYRDPNNYVKLSGRIAAELDNAIWANQFDNLANRDAHYHTTGPEIWQQTDGKVDAWVAATGTGGTYAGVALYLKEQSEAVQCVVADPMGSGLYSFIKTGEINPSGNSITEGIGNSRITANMENVPIDDAVQIDDPEALRVVYQLLRRDGLFMGGSVGINVGAAYQLAKKLGPGHTIVTVLCDGGARYQSRLYNQEWLTSKGLTIPD

SEQ ID NO: 13089 - protein, 402 aa, Synechocystis sp. PCC 6803
MTPELNPNFPEETTSDAWLTPADAGQDGDAQEPAEDGGEEGVVSEELALPEDLPPMDAMVAAVEEMTPVVVPETVPETETPALEDLVAQKTALEKDIAALQREKAQWYGQQFQQLQREMARLVEEGTRELGQRKAALEKEIEKLERRQERIQQEMRTTFAGASQELAIRVQGFKDYLVGSLQDLVSAADQLELGVGDSWESSSTHGDAIIENADPTPVVSFAEQGFSSQKRQIQALLEQYRTRPDYYGPPWQLRRTFEPVHAERIENWFFTLGGRGAILSLDSRLQNILVGSAAIAILNQLYGDRCRALILAATPERLGEWRRGLQDCLGISRSDFGPDRGIVLFESANALIQRAERLVGDRQMPLVLVDETEEQIDLALLQFPLLLAFAPSYQVGGSNYFS

SEQ ID NO: 13090 - protein, 1001 aa, Synechocystis sp. PCC 6803
MNNAKVRIYDLSKELNLENRDILDICERLNVAAKSHSSTISESDAERIKAAAEKFTPQQPKKPRVASRPESKEDKSDPKQQKILAIHHKQEKSGGPSPARPTPPPRPKLQAPKAPTPPQPPVAKASAPKIQKQEEPAQEAPKSVAPPTQPLAPPPVPSLQSPPSKPAPPTPPAKKAAPAPRLAGPPGRTASPNKTAVPAPAKPKVNRPEIVSLKDNRGQARSPGDREEKVAIAAPEPPKPKVELRRPKPPRPEEDENLPELLEFPPLSRGKGVDGDNDADDGDLLSTEKPKPKLKRPTPPRLGKPDQWEDDEDEKANKAKAANKGKRRPKMDDDDDDLDIDGDNGPKPTLVSLSIARPPKPKSLAAKPSTPTVAKVKKPTLKSEAGSSAGGSSRSRGDRRDRKEVVQKPEVIMLDRSLTVRDLADLLKISETDIIKRLFLKGVAVQITQTLDEETARMVAESFEVAVETPERVAAAAKTTEMLDEADLDNLVRRPPVVTIMGHVDHGKTTLLDSIRKTKVAQGEAGGITQHIGAYHVEVEHNDKTEQIVFLDTPGHEAFTAMRARGAKVTDIAILVVAADDGVQPQTKEAISHAKAAGVPLIVAINKVDKPEANPDRIKQELSELGLLAEEWGGDTIMVPVSALNGDNLDGLLEMILLVSEVEELVANPNRQAKGTVIEANLDRTRGPVATLLIQNGTLRVGDAIVVGAVYGKIRAMIDDRGDKVEEASPSFAVEILGLGDVPAAGDEFEVFTNEKDARLQAEARAMEDRQTRLQQAMSSRKVTLSSISAQAQEGELKELNIILKADVQGSLGAILGSLEQLPQGEVQIRVLLASPGEVTETDVDLAAASGAIIIGFNTTLASGARQAADQEGVDIREYDIIYKLLDDIQGAMEGLLDPEEIESSLGTAEVRAVFPVGRGNIAGCYVQSGKIIRNRNLRVRRGDQVLFEGNIDSLKRIKEDVREVNAGYECGIGCSKFNDWKEGDIIEAYEMTMKRRTLAT

SEQ ID NO: 13091 - protein, 304 aa, Synechocystis sp. PCC 6803
MVAIIYSAEFLRHETGPTHPECPARLTAIATALRKMPGANYLHWQKPSPVTWNLDPYILRCHSQEYLNKLAKLAELGGGSLDADTPVSPQSYDVARLAVRAWLDGVDHVLNQREAVFVLARPPGHHAIRNTGMGFCLLNNVAIAAHYALTRPGVERVAILDWDVHHGNGTEALVDHNPRIFYCSLHQFPCYPGTGAAGDRGQHDNVLNIPLKPGGDGKVYREAFEHKVLPFLRQVKPDLLLVSAGYDANHSDPLAYMNLIPEDYGMMTHYLMEISPYPVLGLEGGYHLPSLAKSVVETLKPLLF

SEQ ID NO: 13092 - protein, 306 aa, Synechocystis sp. PCC 6803
MHSPNKFTSGPKQFLESEAITSYADAAVVVVPIPYEATTSYRKGCEHGPEAVLEASDQLEAYDEELGTSPCHDLGIYTCAPLADSNKHPALAGDAMVTEVCDGIAPFVEDGKFVVAIGGEHAITTGVVRAMQRGTSEPFTVVQIDAHGDMRDKFEGSCHNHACVMRRVLELGLPTLPIAIRAICQEEADLIREKNIPVFWAREMADNPNWINEAIASITTQKVFLTIDMDGFDPGFMPGVGTPEPGGLGWYEGLNFFRRLFQTKQVIGCDLMELAPVRGSVVSEFSTAKLAYKLMGYWGESQRKKL

SEQ ID NO: 13093 - protein, 260 aa, Synechocystis sp. PCC 6803
MSEPVQPIIEFRGVSQSFGRKVILDDVDLKIYPGEAVGVIGPSGTGKSTILRIVAGLLTPDSGEVIVHGHRRQRSIEEGEKALGVGLVFQQSALFDSLTVAENVGFTLYRDSDLRPREIRAIVEENLELVGLPGIGDRFPAELSGGMRKRVSLARAIVINPEQHQQYKNILLYDEPTAGLDPVASTRIESLIRHLLSQDHVCCCYLIVTHQFSTIDNTTDRIIFLYDGKIQWDGSTADAYKSEHPLLKQFFSGSIDGPIS

SEQ ID NO: 13094 - protein, 478 aa, Synechocystis sp. PCC 6803
MQATMSQDFDYDLVIIGAGVGGHGAALHAVKCGLKTAIIEAKDMGGTCVNRGCIPSKALLAASGRVREMSDQDHLQQLGIQINGVTFTREAIAAHANDLVSKIQSDLTNSLTRLKVDTIRGWGKVSGPQEVTVIGDNETRILKAKEIMLCPGSVPFVPPGIEIDHKTVFTSDEAVKLETLPQWIAIIGSGYIGLEFSDVYTALGCEVTMIEALPDLMPGFDPEIAKIAERVLIKSRDIETYTGVFATKIKAGSPVEIELTDAKTKEVIDTLEVDACLVATGRIPATKNLGLETVGVETDRRGFIEVNDQMQVIKDGKPVPHLWAVGDATGKMMLAHAASGQGVVAVENICGRKTEVDYRAIPAAAFTHPEISYVGLTEAQAKELGEKEGFVVSTAKTYFKGNSKALAEKETDGIAKVVYRQDTGELLGAHIIGIHASDLIQEAAQAIADRKSVRELAFHVHAHPTLSEVLDEAYKRAV

SEQ ID NO: 13095 - protein, 494 aa, Synechocystis sp. PCC 6803
MGKPTGFLEYTREIPQELSPGDRLRNWDEFHVTMPDKQVETQGARCMDCGTPFCHTGSLISGMASGCPINNLIPEFNDLVYRGLWREALDRLHKTNNFPEFTGRVCPAPCEGSCVLGINNPPVTIKNIEYSIIEKGWQEGWVTPEPPAKRTGKKVAVVGSGPAGLAAAAQLNKAGHWVTVYEREDRPGGLLMYGIPNMKLDKEEVVLRRLNVLEAEGVTFVCNTEIGKDLPPETLLKDYDAVVLCTGATKPRDLAIAGRELEGIHFAMEFLTANTKAILDKTPGPNFISAKDKDVVIIGGGDTGTDCVGTSLRHGCRSLVQLEIMPKPPEERAANNPWPEWPKVYKMDYGQEEAAAVYGHDPRSYLTTATKIEGDDQGRVKAVHTVDVRWEKDGQGRFIPQQVAGTEQVRPAQLVLLAMGFVGPESQLLDAMKLDKDARGNIKAEYGQYETSIPGVFAAGDCRRGQSLVVWAFNEGRGAAKACDLYLMGETDLP

SEQ ID NO: 13096 - protein, 297 aa, Synechocystis sp. PCC 6803
MPPLVVAHLGPRGTNTETVALVYGEQHQERTGQAVEFFPCPSIGKTLEAAAQRLVDVAIVPVENSTEGGIAITLDCLWAAENLKIQQELVLPITHVLLSRGKLLADLTKVVSHPQALGQCQKWLGAHLPQVSLVPANSTTEAIQIIGDDPTAAAIASPRAATLFDLSVLQTDIQDYPDNCTRFWAISSEGYLAGSHTTLAFSVPRNVPGALVAPLQLLAQRNINLSRIESRPTKRSLGEYVFFMDLEASQTEPRLQEALEKLKQYTEVLKIFGSYPTKVLQLADLQHFHPPGWSSPS

SEQ ID NO: 13097 - protein, 264 aa, Synechocystis sp. PCC 6803
MNAVAACFNALRQRGECALIPFLTAGDPDLATTAEALRILDRAGADLIELGVPYSDPLADGPVIQAAATRALQKGVKLDDVLAIVREVHQDIAAPIILFTYYNPIFYQGVEVFLDKIKAAGVKGLVVPDLPLEESDRLLEATAERGLELILLVAPTSSPERQTAIAKKSQGFVYLVSVTGVTGVRTEVGSRVEALLAGMRQVTDKPIGVGFGISQPEQAEQVKAWGADAVIVGSAMVKRLAEGTPTEGLQALETFCRELKTAIS

SEQ ID NO: 13098 - protein, 391 aa, Synechocystis sp. PCC 6803
MQFADRLNAFGGNVFADMDLAKAQARAQGQTIIDLSLGSSDLPTPAPILATIAKALEDPSTHGYLLHQGTLPLRQAIAVWYEKRFGLAVDAETEVLPLIGSQEGTAHLPLAVLNPGDVALLMDPGYPSHMGGVYLAGGEIYPMALRSENQFLPVFTAIPNSVLAKAKMTVLSYPHNPTTAIASLEFFQTAVQFCRDHDLVLVHDFPYMDLVFDGIAMPPSVLQADRQKSCAIEFFTFSKSYNMGGFRIGFAIGNIQLISALKKIKAVVDFNQYAGILQGAIAALESPPETVQQTVQIFAQRRATLIDALAKIGWAVPLPTATMYVWAPLPESWLGNSLEFCQKLVAKTGVALSPGSGFGAGGEGYVRFALVQEPDILATAAKKIGQFLDQN

SEQ ID NO: 13099 - protein, 442 aa, Synechocystis sp. PCC 6803
MKPKNFPLARYVLGAMLAFLFVGVAQAQTETTSIAEVTYAINNLFLLAAAVLVLFMQAGFAMLEAGLSSHKNTVNVLFKNTFDVCVGVLLYFLFGYSLMYGENPVLGGFFGWGGFGITNNLDNVEGLSPQVDWLFQAAFAATAATIVSGAVMGRMYFKAYLIYSAVITGLVYPISGHWKWGGGWLDKLGFHDFAGSLLVHSVGGFAALAAVVVMGPRIGRFEGNKINSLGYQGITSSSLGVFILWVGWYGFNPGSQLAFVGALNTNTTMLIAVNTTLSAAAGGLAALAFDWITENKRKPNLLVTLNGILGGLVGITAGCDTVSNWSAIAIGVVAGILSVLGTKLLDRLRIDDGVGAWPVHGLCGIWGGIAVGIFSTNVEHKLSAQIVGSLVIPFWAFITMFFLFYVMDLWGILRVKPSQEKVGLDIVEHGQTEKGVEIAFED

SEQ ID NO: 13100 - protein, 260 aa, Synechocystis sp. PCC 6803
MTEPLIQLRGISKSFGDRQILDSVDLDLYPGEALVVIGPSGTGKSTILRIIAGLLPPDSGEVLIKTQPRRGLVEDDNERIRIALVFQQSALFDSLTVAENVGFFLLEHSSLSREVIREQVADKLALVGLTGIEDYYPAQLSGGMRKRVSFARAIMSNPHQPEDNPEVILYDEPTAGLDPIASTVIEDLVRRLQKSPGGCGTYIMVSHQESTIRRTADRVVLLYDGKIQWQGPVSAIDQTDNPLVRQFFEAKVEGPIRILD

SEQ ID NO: 13101 - protein, 429 aa, Synechocystis sp. PCC 6803
MTYSPVVESVEAQAFAVTDLSPAAEFKTADFDTYVMNTYGRFPIAIARGQGSTLWDTEGKSYLDFVAGIATCTLGHAHPALVRAVSDQIQKLHHVSNLYYIPEQGELAKWIVEHSCADRVFFCNSGAEANEAAIKLVRKYAHTVLDFLEQPVILTAKASFHGRTLATITATGQPKYQQYFDPLVPGFDYVPYNDIRSLENKVADLDEGNSRVAAIFLEPLQGEGGVRPGDLAYFKRVREICDQNDILLVFDEVQVGVGRTGKLWGYEHLGVEPDIFTSAKGLAGGVPIGAMMCKKFCDVFEPGNHASTFGGNPLACAAGLAVLKTIEGDRLLDNVQARGEQLRSGLAEIKNQYPTLFTEVRGWGLINGLEISAESSLTSVEIVKAAMEQGLLLAPAGPKVLRFVPPLVVTEAEIAQAVEILRQAIATLV

SEQ ID NO: 13102 - protein, 369 aa, Synechocystis sp. PCC 6803; identical to SEQ ID NO: 633

SEQ ID NO: 13103 - protein, 390 aa, Synechocystis sp. PCC 6803
MSDATPFRPPSEAEEALIKETRLPLTGWQQEVDQGLTYGLEAAASIKDRSIPTFSRGELPHYAGINTFMKAPYLEDVREVGKYDVAIVGVPHDSGTTYRPGTRFGPQGIRRISALYTPYNFEMGVDLREQISLCDVGDIFTIPANNEKSFDQISKGIAHIFSSGAFPIILGGDHSIGFPTVRGICRHLGDKKVGIIHFDRHVDTQETDLDERMHTCPWFHATNMANAPAKNLVQLGIGGWQVPRQGVKVCRERATNILTVTDITEMSLDAAADFAIARATDGTDCVWISFDIDCIDAGFVPGTGWPEPGGLLPREALYLLKRIIRETNVCGMEVVEVSPPYDISDMTSLMATRVICDTMAHLVVSGQLPRTEKPAYIHAEANMAVDEPWQ

SEQ ID NO: 13104 - protein, 187 aa, Synechocystis sp. PCC 6803
MAMAKGLIFLGAPGSGKGTQAVGLAETLGIPHISTGDMLRQAIADGTELGNQAKGYMDKGELVPDQLILGLIEERLGHKDAKAGWILDGFPRNVNQAIFLDELLVNIGHRTHWVINLKVPDEVIVERLLARGRADDNETTIRNRLLVYTEQTAPLMAYYQEQGKLYSLDGNQPVEAIATNLEKLVKP

SEQ ID NO: 13105 - protein, 247 aa, Synechocystis sp. PCC 6803
MGSYSQLDLDISLCTKYRLLCNAGDSLISLLPHPMTATVTAQEAFRAAYENRYTWDENFPGYRAHLTVTQGDERYEGEVEVKADYTVTVTGFSDETVQESVYNQMRDIVTHRKQGNFEKSHGKNEFSFGETDASGAIAIDVKGDAMGSNYKIRGTEICQVSRVMGPVAFTINTEESLDTGSGYIAIKYNAIFKDPKTDTLKGKRDFTETYGELGGYYLPTQQTVEAIAAGGEKIFTDFSFTNLELLA

SEQ ID NO: 13106 - protein, 129 aa, Synechocystis sp. PCC 6803
MHDSPEASSPAPTPHPETTRTPPWGMVTMLEEGPRYRINRIVVKPGQHMSTQMHYHRSEHWVVVSGTAKVICNGEEKLLNQKESTYVPMNTPHRVENPGVIDLVMIEVQNGEYLGDDDIVRFPEELPKS

SEQ ID NO: 13107 - protein, 331 aa, Synechocystis sp. PCC 6803
MGFFVVRCRQISLLGGPLPMKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 13108 - protein, 307 aa, Synechocystis sp. PCC 6803
MAEVVCFGEMLFDCLADQLGVPLEQVKSWTNYAGGAPANVACALVKQGVSAAFVGRLGADQAGQELKNVLQQCQVNTDGLQIDPHRPTRLVYVTRTGDGDRHFAGFGEYHTGDFADTAMQGETIPESLFTSAQYLVMGTIALAYAPSRTATERLVALAKKHQVKIFLDVNWRSVFWDDEAQAKERIPALITHAQILKCTDEEAVWLFGHQDPVTIHQKLPHLQGVLVTAGDKGCSYSLGKNHGEVPAFKVNVRDTTGAGDSFVAGFLAQALTHGENLFIDPHLSCQAVTYASAIGALTTLHPGAIAR

SEQ ID NO: 13109 - protein, 3016 aa, Synechocystis sp. PCC 6803
MAASTQTPAIAVDSNGFTHLVWNQNNVIYHAYYDPSVGRWRESAPIANSVSAKELKITTGVRSQGEETGSSVEGIFISWIEGEGNNSDIHGASGILNSLGQYNWGQTFKLTDDAVSDENMRLQTTADGNLLLITEKIDLDDPQADRDLYSQVIDLRNRETLHNTLTQVKPLNPSNFIAPNASPTLALGDGDIQVPGTFLITKENKKEYQLPLSFFNGKLEFKNALALGGGINFTNLINSGDPGLSAFLQLQDELSGALSFGKNKVSLKGRLQGKLQLDFLLNGDGNTFSASDALRLRGEYERNLLPGKTTYDIGFSVGGVPISLLDAEVQLGLLFDLAFTLKQKWSTDFDLTPQALVTGGSTLAETQTENTTVEYWYSLVRADGTPAQPGDDPSQLYWLINSDQAADNLLAPPPGLEAPSPAELALIPGVENTGLLSFGTGLSGKLKLALLGFTAFDFESKLEILANFEVFPNVGFDSLEETLALGLNLFGKKWSTTLKVEQNFDNPSLIAENLSTTLNADDLLVGINPDFIQGSTAIYAGNPLDGTSVGSNLTDDTSPSILVASDGNLYATWVKNTHNESLSQVLLAKSTDGGNTWSNPLVIPNSAGMNFNPVIGTTVTGQLLVVWSNASPDIFNPDGSVNRPEFVESLAASTLFYSTSNDNGATWSDAIPINPDIKTPQALTLTQLANGALLLSWVVADTLIPDTGLYTNGGDTKNDVLYSSFWNGTSWSNAQIVASGDLRLLETPVSATVGGEATIFWTEVNPAADDGISIFYSSYNQQFAQWTPAVLFAPDLSNLTTFQTVAEAIEISNSISNQTVNSAFDQPTHNSVVAESDLRLVIPHNNSQGSSQLQVSPIRVKETDGEAVLLVRRTGNIQEAVSFNYRTVDGSATAGADYVAQAGTLTFAPGEVFKEIRIAILDDDITERRAEKFRVVITSDHEGAHLRLDGLRLGNTRLELVATVTTIEDEPTSLSEIDSGFILNADPLAQAGMAIAPGGDINSDGTDDFLVGAPAKNGGNGAVYVVYGNPTIGIRDQGLSLDSLDGTNGVIIQGASQSLLGTAMATADLDSDGLSDLVLGAPQNSVQNSAGKVYILRGSNVEGQSTIDLSTASSLVLESNQAGNAAGFKTAIADVTGDGLADVIISAPAINTIYVVFGSAIKNALNSNTPSLNLDNLGSDGFLLNTGIGQIGTGLGVADINGDGVFDLLLGAPQANPVDYSGSEDADSKPLAYGGQVYVAFGGTGLNGSLNLGQLNGSNGLILNGQAFYNQSNLGGGTPSDPNLQPDFTIADNAGTNVVNAGDINNDGFDDFIISAANSAANGINGLGRAYVVFGKASGWNSAINLQNLDGTNGFIINGIYDTTQNLGGNAGYWISAVGDINNDFFDDFIISAPTLGTNGPNSATGQSYLILGTSQWANFLNQGVLELSDVNTLNSRVFLFNNPNSGTQLGLGLGSIGDVNGDGSPDMAIATPQIYPGVETSQIYVAYGHPWVGAGGSIDVTKLRSDNGFVFQPVTKNEIGTVQLGADINNDGYVDTLIADAGFNGAGGKIVYLFFGSDPAQPSTFVDSVAITIASNDGLILGQQTLDYGDFNNDGITDFVVSRSGALGQSYATIILGSEDSSIWSSINPDTGIDINNLLASNGGVNITVPNVPNQGALVNLASGDFNGDGIDDVLLSSANLNPVIVFGKETWSSGVTSNVNVLNESLPIQIEAGKPITAVNSLGDVNGDGYEDFGLIGIDEVNENLYGYVIFGKNNLASNSSLNLATLNGSNGFKLTSPSISSISEQGGVGSISLAGDLNGDGFGDFIVGLTNDLNFGKNGAAYVVFGGRNLGSSGSFNLSNLNGGNGFTIQQAPGSEDLVGYSIAGGGDINGDGYDDLLVSAPSAGVGNPDGTNNGDTEGTIYTLFGSSILGVGGTVDLSNLNGSNGFETVGAQAYSFAGSFVGGLSDVNGDGYADLGIGAQGDNSQGVSGLAYNVFGGDFTQNVTYVGTIDNDIFSATSLATSSAPHIMNGGQGNDILQSAGVNVSAGGRVVMNGGQGNDLLSIGSLNFERLDGGSGKDILQLNSYILSSNNLDLTDTTIGSRIRGIEVIDLGINNRVTLNVETLTALSDTTNTFTVLGHNSFIVASDFQNWTKSGTVTEQGVTYDQYINKGTKLLIQQSNNLFESTAVSSVAVYGTENGETLVPGIFPGFVGKDNIIFALGGDDLVDLSLAQGNNQVYGGPGNDRLIAGQNDSLFGGLGNDILDTSGDRGTNNLNGGDGDDTFFLGQGDKAFGNDGNDRFFMRGSGRNLISGGAGADHFWIADIDFTNSFNAILDFELGIDTIGLKGLASRQDDLKLIQYGTDVLIALGDEYLARVTGVLRPFLEVVSDGIDLFVQGAQDVSPIVVSNTNDSGAGSLRQAIIDAGANASPDTIDMTGIAAGTIILNSPLPTLNNRNDITFVTLGAFGTPTIKFNNPSAFNNIFTLEGVAVNLSYMNLQNGYAKGGDGVSGGGGGAGAGGALTILQGSTVIIDNVSFDSNRAVGGNGTAGARGGGGEIFGTPDDRPSAGGGGGNFNASGNANNGGAAGSVGDDKAGGTGGTGGTGGFGIGGGGGGGGGGSSSGSPFDFTPRNGGSGGPGGAGGFGAGGGAGGGGGGSSGQNPGDDKRGGFGGSGGSGGGNPIGGNGSVGSQGGAGNTVEGGSPGNGGSGGGGAGLGGALFINQATVTITNSQFSGNTTQGGTGGNSGQALGGAIFITDNSFVTGAGLTFSNNSAPSSPGGSFSNAYGQFQNNNDVYGTIDSLSNASTNLFLVPPLTPEVQNEISVVAKDNLFFVQLPDGSEVSLLYEDQPFVSGSFGNWQILEAETINGVNNVLWQNPDIDEIGVWNADSNWNWISSETWPTNSFNTLEAEINFQIDLNGDELLGDRLTNIESKGNTSFLEGIFGNYYVQTGDDLTAPIKYLGEVFENNFGDWQGLAAETVNGINQVLWQNLETSEIGVWSTDSNWNWLSSDVFAAGSLQALEQQLIFAVDVN

SEQ ID NO: 13110 - protein, 508 aa, Synechocystis sp. PCC 6803
MPHHYDRVNINKLLTRTRITMVTTPDWVKKAVFYQIFPDRFAIGQQQAIAVAQQPKLEPWEAPPTVQGYKGGNLWGVIEHLDYLQDSGITALYLTPIFQSACNHRYHTHDYYQVDPLLGGNEALQALLTQAHRREMKVVLDGVFNHASRGFYFFNDILENGPHSPWLDWFHIEDWPLSAYDGSLPANYRGWVDLRALPQFNHDHPDVREYLMRVGEYWIAQGIDGWRLDVPDCVKAEGFWQEFRCRVKAINPEAYIVGEIWCDASPWLAGDQFDGVMNYRFTEPTVAFAIGDRLQKEHLRGEEYRPYPALTAEAYGERISQLLQQHPWEIQLTQLNLLNSHDTARLLTLANGDRPSVNLALLLMFTFPGAPCVYYGDEVGLPGEADPDCRRVFPAKTDWDLDCWEFYRQLIALRHRYQCLQLGDYKIIATAGMGYVFQRQYGDETLMVAVNSGDNIIEIILSPDIINLDKIDIAEPVFSANGETVIDRNTAGLLLTMAPQSGAAFAII

SEQ ID NO: 13111 - protein, 235 aa, Synechocystis sp. PCC 6803
MMDFQDTWALLHPAIAVVVVFPLLGIVLNRALLTRERRLAMKVGEKSKIPPIVGTEHVAIGRYLSMAVVGVTFLGLAYPIFSKFINKNLISEEPFRVLFIIALFILSITSFIFLFQAKTRIWRGIFATLTGMGLVLLGCQPEIYRRDHEWLVSHFYYGILAALLMIFSVATIQDIYQDRRNRWRNAHIIINSFALLLFIGQGITGARDLLEIPLHWQKPYIYQCDSVGKTCPQFK

SEQ ID NO: 13112 - protein, 247 aa, Synechocystis sp. PCC 6803
MKKYIAEFIGTFWLVLGGCGSAVFAAFIAAPGGGNTNEFGLGYLGVALAFGLTVFTGAYALGHISGGHFNPAVSFGLWMGKRFPGSQLAPYIGAQVLGAIVASLFIFIVAQGGPNFSLDGSNPLATNGFGDHSPQGYGFLAALLIEFVLTFIFLIVILGVTDKTAPAGFAPAAIGLALTLIHLISIPITNTSVNPARSTGVALFCGNPALIGQLWLFWLAPIAGALLAGFVYHNVLEDLGRPEPEAE

SEQ ID NO: 13113 - protein, 154 aa, Synechocystis sp. PCC 6803
MPLPTSLTTLDGTPLAPEVIADKVVLFVNVASKCGLTPQYSGLVALDKAYGEKGLVIIGVPCNQFGAQEPGSPEEIKDFTKTKYDVDFTLLEKQDVNGPNRSPLYQFLVGDGEDISWNFGKFLIGRDGQVVARFDPQTKPDDTNLKAAIEKALG

SEQ ID NO: 13114 - protein, 387 aa, Synechocystis sp. PCC 6803
MNITIGRGKTARRAYGIDEIALVPGVRTLDPALADTRWKVGAIEREIPIIASAMDGVVDSRMAVLLSELGALGVVNLEGIQTRYEDPNPILDRIASVGKTEFVGLMQELYAEPIKPELITKRIQEIQAAGGIAAVSLTPVGASKYASTVAEAGADLLFIQATVVSTAHLSPESVESLDLVKLCQEMPMPVVLGNCVTYEVSLELMRAGAAAVLVGIGPGAACTSRGVLGVGVPQPTAIADCAAARDDYLQETGRYVPVIADGGIITGGDICKCIACGADAVMIGSPIARAAEAPGRGFHWGMATPSPVLPRGTRINVGTTGTIREILVGPAKLDDGTHNLLGAIKTSMGTLGAKDMKEMQQVDVVIAPSLLTEGKVYQKAQQLGMGK

SEQ ID NO: 13115 - protein, 292 aa, Synechocystis sp. PCC 6803
MESNFLTTIFLPLALFLIMFGMGLGLTIKDFNRIWLEPKAVAIGLIAQLVMLPMVGFGLSSLFSLSPELAVGLMILAACPGGSTSNVITYLLKGNVALSITLTAISSLVTIITIPLVVNLAANYFMGEQFALQLPFLKTVLQIAVITIIPVSLGMIFYHFLPKIAMVMEKNVKWLSLFFLGIIIVAILVKERENLADFFLQVGGVTVTLNLLTMGLGYGIAILAGLGLAERKSITIEVGIQNGTLAIAIATTLLNAPIMAIPAAIYSVVMFLTSGIFAGLLKAKIFRGLKST

SEQ ID NO: 13116 - protein, 318 aa, Synechocystis sp. PCC 6803
MKWKVLVTCPPMLHTLEHCQTRFEQEQLDVVAPTITQQLSEAELCEQIADFDGVIAGDDPFTARVLTIGKQGKLKALAKWGIGVDAIDLAAAKQLGILTSNTPNVFGDEVADVAIGYLILLARELHCIDQAVRQGEWLKIRGHSLRGKTAGIIGVGSIGQAIAVRLQSMGLKLLGYDPHPISADFCEQTGLHPVPLQDVLQQADCLFLACNLTPDNFHLLNADTFDQMKPGVWLINVARGGLVDQAALIETLQTGKVAKAALDVFEQEPLAADSPLTQLPQVILGSHNGSNTREAVLKVNQLAIDNLVRDLQRATSGD

SEQ ID NO: 13117 - protein, 230 aa, Synechocystis sp. PCC 6803
MSKNIVVAPSILSADFSRLGEEIKAVDEAGADWIHVDVMDGRFVPNITIGPLIVDAIRPLTKKTLDVHLMIVEPEKYVEDFAKAGADIISVHVEHNASPHLHRTLCQIRELGKKAGAVLNPSTPLDFLEYVLPVCDLILIMSVNPGFGGQSFIPEVLPKIRALRQMCDERGLDPWIEVDGGLKPNNTWQVLEAGANAIVAGSAVFNAPNYAEAIAGVRNSKRPEPQLATV

SEQ ID NO: 13118 - protein, 173 aa, Synechocystis sp. PCC 6803
MPRTQRNDNFIDKSFTVMADIILKILPTNQKAKEAFVYYRDGMSAQADGEYAEALDNYEEALRLEENPNDRSYILYNMALIHASNGDHEKALGLYQEAIELNPKMPSALNNIAVIYHFQGEKAKEAGQEDDAENLFDKAAEYWKQAIRLAPNNYIEAQNWLKITGRSEMDVFF

SEQ ID NO: 13119 - protein, 368 aa, Synechocystis sp. PCC 6803
MTVAQFSPVARLSIEDSVLTVQDLGKSFRGQSTPVLQKINFNLAPGEILGLLGPSGCGKTTLLRIIAGFETPTSGTVHLEGDCVSGENGLTPPEQRQTGMVFQDYALFPHLTITDNIAFGLRHKSQKLNRQQIQGRVAEVLHLVGLTGLEKRYPHELSGGQQQRIALARALAPKPNLILLDEPLSNLDVQVRQRLRHEIRHILKATGTAAIFVTHDQEEAMAISDRIGVMYRGNLEQIGTPEEIYRSPASRFVAEFVTQANFVPAQRQGTLWATEFGQWPLTFQGIQPELPSVGELMLREEEIELSPASDGPVVIRDRQFLGREYRYCLETPAGRQIHARTSLQTVIPVGSRVNLTPTNPCPPLFAQG

SEQ ID NO: 13120 - protein, 367 aa, Synechocystis sp. PCC 6803
MEIPGQSILPPMNTSSPVFIPVILAGGKGERFWPLSRRQRPKQFLSLDGSGVSLLQATAQRLLSLAGDWENLWVITAAPIAEGVFEQLPSLPKENCLVEPEGKDTAPAVAWASLEIAQQYGDDAIIGFFPADHWIKDQCAYEQTLKAAIAYAQEQDAIVTLGIKPHGPATGYGYIEQGTLEREIDGLPVYQVTRFTEKPDRATAQTFVDSGKFSWNSGMFIFRAGVVLRELDRHAPELLATLRAKGAAGYPALEKKSIDYVLMEKTQLAAVLPANFGWDDLGDWNALERLFPETEANVDLANHVNLHSRGCIVYASDENQIIATIGLKDVVIVREGNVTLVVPKDHTQDIKDLLKQLQSQPEYENLL

SEQ ID NO: 13121 - protein, 146 aa, Synechocystis sp. PCC 6803
MFLTALRSFLLFLAVTCLSLAIAMPAWALTEVPLTEIDYKPCPADLAEGNVGSGSSSPANCFLVTGIANNRTGKTVYDADVFGRIYDANHEPAMQNRTRLGNIAEIPPGKSDFEVRISVPAQQPLPLQLEQFKASGFSAKIRGQAL

SEQ ID NO: 13122 - protein, 169 aa, Synechocystis sp. PCC 6803
MTAQANNTIYGFSANALDGSPVALRDFEGKVLLIVNTASQCGFTPQYQGLQALYNRFGDRGFTVLGFPCNQFGQQEPGGSGEIKNFCETRYGVTFPLFEKVEVNGPNAHPLFKFLTAASPGMAIPFLGGAEDIKWNFTKFLVDRQGKVVKRYGSIAKPDEIAADIEKLL

SEQ ID NO: 13123 - protein, 413 aa, Synechocystis sp. PCC 6803
MYSPGYVATSSRQSDAGNRLFVYEVIGLSQSTMTDGLDYPIRRSGSTFITVPLKRMNQEMRRITRMGGKIVSIKPLEGDSPLPHTEGIAKPSQSEGSGSEAVANPAPESNKTMTTTPKEKKADDIPVNIYRPKTPYIGKVLENYPLVREGAIGTVQHLTFDLSAGDLRYLEGQSIGIIPPGEDDKGKPHKLRLYSIASTRHGDFGDDKTVSLCVRQLEYQNEAGETVQGVCSTYLCNIKEGDDIAITGPVGKEMLLPPDEDANIVMLATGTGIAPFRAFLWRMFKEQHEDYKFKGLAWLIFGIPKSENILYKDDLEKMAAEFPDNFRLTYAISREQQNAEGGRMYIQHRVAENAEELWNLMQNPKTHTYMCGLKGMEPGIDEAFTALAEQNGKEWTTFQREMKKEHRWHVETY

SEQ ID NO: 13124 - protein, 505 aa, Synechocystis sp. PCC 6803
MAKARTKFVCSACGADHAQWFGRCPKCHEYGSLQEEIVNAVSSGTNHRSLGAQKSRSSKVKTGQPQAALTFSQIRQENQGRFLSGYGELDRVLGGGIVPGALILIGGDPGIGKSTLLLQVAFQLATRLPRILYVSAEESGQQIKLRATRLGITQTVEPSQAQDGINNLAHDGNLFVLPETNLDDILRELEALQPQVAIIDSIQNLYFPALSSAPGSVSQVRECTGLLMQLAKRDHISLFIVGHVTKEGAIAGPKVLEHLVDTVLYFQGDRFASHRLLRSVKNRFGATQEIGIFEMVQSGLQEVLNPSQLFLGSREEFMSGTAITVACEGTRPLVVELQALVSPTSYASPRRSTTGVDYNRLLQVLAVLEKRLGVPLSKLDAYLSVAGGLEVEEPAVDLAMAIALVASFRDRVVDPTMIILGEIGLGGQIRPVSQLEIRLKEAAKLGFKKAIVPKGQTGIESAGIKLIPVGKVFAAIAVALPANENTTDQGNGSEAKIEEDLGKKD

SEQ ID NO: 13125 - protein, 374 aa, Synechocystis sp. PCC 6803
MPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 13126 - protein, 155 aa, Synechocystis sp. PCC 6803
MLYFILCRLLKKTSPRNQASFNGKNNPMPNASTALTGKALLNKVKELSHLPRRETAKACGYYSTSKEGQVRVNLTDFYDAVLAAKGVPLDPSGTKDGRGREPTFRVSVHKNGQIVIGSTYTQEMGLKSGDEFEIKLGYKHIHLKQITDSDDEEEV

SEQ ID NO: 13127 - protein, 482 aa, Synechocystis sp. PCC 6803
MQFNVAIMTKRTFGVIGLAVMGENLALNVESRGFPIAVFNRSPNKTEKFMAERAVGKDIKAAYTVEEFVQLLERPRKILVMVKAGGPVDAVINELKPLLEEGDMIIDGGNSLYEDTERRTKDLEATGLGFVGMGVSGGEEGALLGPSLMPGGTPAAYKELEPILTKIAAQVEDPDNPACVTFIGPGGAGHYVKMVHNGIEYGDMQLIAEAYDILKNGLGLSNEQLHEVFGQWNQTDELNSFLIEISTDIFAKKDPETGGHLIDYILDAAGQKGTGRWTVMSGLELGVPIPTIYAAVNARVMSSLKEERVAASGQLSGPSKTFSGDVEAWIPKVRDALYCSKMCSYAQGMALIAKASQEFGYDVNLPEIARIWKGGCIIRAGFLDKIKKAFKDNPQLPNLLLAPEFKQSILDRQGPWREVLMLANEMGIAVPAFSSSLDYFDSYRRAVLPQNLTQAQRDYFGAHTYERTDKPRGEFFHTEWLD

SEQ ID NO: 13128 - protein, 242 aa, Synechocystis sp. PCC 6803
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 13129 - protein, 411 aa, Synechocystis sp. PCC 6803
MPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 13130 - protein, 394 aa, Synechocystis sp. PCC 6803
MSLNWISRADRLQALPPYVFARLDELKAKAREQGLDLIDLGMGNPDGKAPQPIIEAAIAELENPESHGYPPFEGTQSFRQSITRWYARQYGVDLDPDSEALPLIGSKEGLGHLALAYVNPGDLVLVPTPSYPAHFRGPLIAGAEIYPIMLSAKDDWLIQLDQIPEAIAQRAKILYFNYPNNPTTATAPREFYEAITDWARHYQIMLVHDLCYAELAFDGYQPTSLLEIPGAKDFSVEFHTLSKTYNMAGWRVGFVVGNQEIIQGLRTLKTNLDYGIFRVVQKAAETALSLPESYIEVVRKRYQERRDFVINGLSKLGWSITPSQATMYLWVPCPVGMSSTDFALTVLEKTGVVMTPGNAFGEGGERYVRLSLIADGDRLGEALQRIEQAGIRYS

SEQ ID NO: 13131 - protein, 290 aa, Synechocystis sp. PCC 6803
MNVSKIAVFGLGVMGSPMAQNLVKNGYQTVGYNRTLERPSVQEAAKAGVKVVTSIAVAAANADIILTCVGDEKDVQQLILGSGGIAEYAKPQALIIDCSTIGKTAAYELATNLKLQGLRFLDAPVTGGDVGAINGTLTIMVGGDISDFEEALPVLKSIGEKIVHCGPSGSGQAVKLCNQVLCGIHAIAAAEAIQLSEQLGIAPELVIDTCGSGAAGSWALTNLAPKMSEADFAPGFMVKHLLKDLRLVREAAENGPLPGVTLAESLFTSVQLLGGEDQGSQAIIRAYREA

SEQ ID NO: 13132 - protein, 497 aa, Synechocystis sp. PCC 6803
MSMQFMETGMPDLLNSPQAIASALEFSLKNGLGILGQELPLDWQIWEEEYEQSLTGIESPQILLAETNVGKFWAAVVAFLRVGRGTLFIANHQWQQREWQQVAQFLQPDRLWGSLMWQQQWLKLTDSNSELTSVHHKTNTPKNQLEGKSPELLIGFPTGGSSGTIRFALHSPQTLTMAVDGLKQFLGPLLPRNGQINSFCLLPLYHVGGFMQWWRSALTGGNFSPLDYSLVKQSAPPFPPDYVTSLVPTQLEYLLDRHGAWLKNFRLIFLGGAPAWPALLAKAKTASLNLAPTYGMTETAAQIATLTPAEFLAGQTGVGKLLPHVQLTITNSKDEMVAPGTVGLINIQSRALFKGYVPQNENSSREIFTTGDLGYCHNGYLHITGRRGRRLISGGENIDPEDIEALLLDRHLVQDVVIVGVGDRHWGEMLVAVYVPNPGPGNDVSTLSQCVKAQLSKPKCPKHWLPVSTLRRSPLGKLNYQFWQTWATEQLGVEEEE

SEQ ID NO: 13133 - protein, 128 aa, Synechocystis sp. PCC 6803
MIATPLAQAATTPSHLPTETRPWGSFTTLEEGNGYKIKRIEVNPGHRLSLQMHHHRSEHWIVVSGTARIVCGDKEELLEPNQSTYVPQCTAHRLENPGVIKLVLIEVQNGEYLGEDDIIRFQDDYARG

SEQ ID NO: 13134 - protein, 219 aa, Synechocystis sp. PCC 6803
MAIAKLPRQILPNLYRFAPNRDTLGGTAYLLITGEGNVLIDCPAWHEDNEAWLGEQGPVRWLCLTHRDGHGPKVKTIQEKLSCQVVVQEQEAYLLPGARICRFREQLAMAPFLTAIWTPGYSPGASCYYWGENGGILFTGRHLLPDGEGNLRAIKQAKTFHWPRQQASVEKIHRYLDEKNLPLRAVCPGGNVGYLRGEDWCLNPRESLESMLREFQAKV

SEQ ID NO: 13135 - protein, 461 aa, Synechocystis sp. PCC 6803
MTDISMRFGMQAEAREFLKLAVPLAGAQMAQAATGFVDTVMMGWLGQDVLAAGGLATMIFMAFMMTGVGLISGVSPLVAEAYGAGQTRRIGQLTRQGLWIVLLLSIPGMLFITHLNGVMHWSGQADTTIILSDSYLNVMAWGLFPAIAFATLRGCIIALSQARPIMLIVIAATLFNILGNYGLGFGKWGFPALGITGLAIASISAHWIMFLSLLVYMLWHKPLHQYSLFDSLHHLKPRILQQLLWVGGPIGIAAVLEYGLYLTASFFMGALGTPILAAHQVVSQTVLVLFMVPLAMSYAATVRVGQWFGQQHWPQIRQAALVSIGLAVLFMLTAGIALLAYPQQIIGLYLDLNDPANGEALNVGISIMKIAAFGLVLDGLQRTANGVLQGLQDTRIPMVLGTIAYWGIGLTASYLLGFYTPLSGAGVWIGTYIGLAAASIAYLWRFQKVMVRKKSLPVARS

SEQ ID NO: 13136 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 13137 - protein, 456 aa, Synechocystis sp. PCC 6803
MNTAKTVVAEQRDFFRQGKTKSVQDRLTALAKLKTQIQAQEEEIIKALKQDFGKPTFESYVNEILGVIREINYYQKHLQQWSKPQRVGTNLMVFPASAQLRPEPLGVVLIISPWNYPFYLCLMPLIGAIAAGNCVVVKPSEYTPAISGVITRLIQNVFSPAWATVVEGDETISQQLLQEKFDHIFFTGSPRVGRLIMAAAAEQLTPVTLELGGKSPCVVDREINLQETAKRIMWGKLVNAGQTCVAPDYLLVEQSCLEQLLPALQQAIQMLFGENPAHSPDYTRIVNQQQWSRLVSLLSHGKVITRGDHNEGDRYIAPTLIIDPDLNSPLMQEEIFGPILPILTYQSLSEAIDFINIKPKPLALYFFSNNRQKQEEILQSTSSGSVCLNDILLHLTVTDLPFGGVGESGMGRYHGKATFDTLSNYKSILRRPFWGETNLRYSPYGKKMNLIKKLFS

SEQ ID NO: 13138 - protein, 332 aa, Synechocystis sp. PCC 6803
MASTDFKDYYQILGVTKTASEAEIKKQFRKLALKYHPDKNPGDKAAEEKFKEISEAYEVLSDPEKRQKYDQFGRYWQQAGTAGQPSGSYGPGVGVDFGGFDFSQYGNFDEFINELLGRFNTPGGGGQRTSYSYSTGGPGFNDFGGFGNAQAPAGDREATLQLTLAEAFRGVEKRLNLGEEMVTVRIPAGAKNGSRVRVRGKGMASPYGQRGDLYLNLQLTPHPFFQFEGDNLVCELAIAPDEAVLGADISVPTPDGMVRMKVPAGVKSGQSLRLKGKGWPNPKQGRGDQLVRLIITAPKNPSAIERECYEKIQAQRTENPRQAVEKYANLLA

SEQ ID NO: 13139 - protein, 322 aa, Synechocystis sp. PCC 6803
MEQPMKPTVIITGASSGVGLYGAKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 13140 - protein, 483 aa, Synechocystis sp. PCC 6803
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 13141 - protein, 507 aa, Synechocystis sp. PCC 6803
MSNSILSKLNVGERSPVNRTHSSRTEAEKSSLFRFVRRKINSPWLACVPLTALIVAIWNAAAIAQDTEIVNITVETVNENVATLQGTLNAIWILIAAILVIFMNAGFGMLETGLCRQKNAVNILTKNLIVFALATIAYWAIGFSLMFGSSGNPFVGFGGFFLSGDHTNYGLSPFPEGLPVAVFFLFQVAFSATAATIVSGAVAERIKFNEFLIFSVLLVGIAYPITGHWVWDAGGWLYTMGFMDFAGSTVVHSVGGWAALAGAFLLGPRLGKFVDGRPGAIPGHNMGFAMLGCLILWIGWFGFNPGSQLAADQACAYIAVTTNLAASAGGLTATFTSWLKDGKPDLTMVINGVLAGLVGITAGCAGVSYWGSVIIGGIAGILVVYSVAFFDKIKIDDPVGAISVHLVNGVWGTLAVGFFNMEKGLFYGGGINQLIIQIVGILAIGAFTAIFSFVVWAILKQTMGIRVSGEEEMIGLDIGEHGMEAYTGFVKETDSFGSAVSGATVPE

SEQ ID NO: 13142 - protein, 133 aa, Synechocystis sp. PCC 6803
MVIADLNFPPDHRSGLEPELGGDWRNFDDRSGLEPELGGELRERGVYVDEVTCIGCKNCAHVAPNTFTIEQEHGRSRAFSQNGDDEAVIQEAIDTCPVDCIHWVPYDELKHLEEKRKHQQIRPLGYPQINPHL

SEQ ID NO: 13143 - protein, 333 aa, Synechocystis sp. PCC 6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 13144 - protein, 355 aa, Synechocystis sp. PCC 6803
MSIIINNVSKQFGDFTALKDINLEVPDGKLVALLGPSGSGKSTLLRAIAGLEEPDQGQIIINGQDATHVDIRKRNIGFVFQHYALFKHLTIRQNIAFGLEIRKHPPAKTKERVEELLSLIQLEGLGNRYPSQLSGGQRQRVALARALAVQPQVLLLDEPFGALDAKVRKELRAWLRKLHDEVHLTSVFVTHDQEEAMEVADEIVVMSNGKIEQVGTAEEIYEHPASPFVMGFIGEVNVLPRNASLFNYHAFEPHSSNNGHQEPVFVRPHDFELLTEADDASVAGTIKRVIHLGSEIQVEVLLMDNTAVLAYLNREQGQQLNPKAGKKVFIKPRVAKVFAGASSAASTHFIYGTGI

SEQ ID NO: 13145 - protein, 333 aa, Synechocystis sp. PCC 6803
MKIAFFSSKAYDRQFFQQANHPHQREMVFFDAQLNLDTAILAEDCPVICLFVNDQAPAPVLEKLAAQGTKLIALRSAGYNNVDLKTAADLGLKVVHVPSYSPHAVAEHTVGLILALNRKLYRAYNRVRDDNFSLEGLLGFDLHGTTVGVIGTGKIGLAFAQIMNGFGCHLLGYDAFPNDKFTAIGQALYVSLNELLAHSDIISLHCPLLPETHYLINTNTIAQMKPGVMLINTSRGHLIDTQAVIQGIKSHKIGFLGIDVYEEEEELFFTDHSDTIIQDDTFQLLQSFPNVMITAHQGFFTHNALQTIAATTLANIAEFEQNKPLTYQVICPH

SEQ ID NO: 13146 - protein, 432 aa, Synechocystis sp. PCC 6803 [sequence omitted]

SEQ ID NO: 13147 - protein, 336 aa, Synechocystis sp. PCC 6803
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 13148 - protein, 230 aa, Synechocystis sp. PCC 6803
MSSRSAGRNSPILPLMSHSDLPLANAVPLDKIRYNDQGLVPAIAQDYLDGTVLMLAWMNEAALAKTLATGQVWYWSRSRQELWHKGATSGHFQKLLGIRYDCDSDALLLTIEQKGDIACHTGERSCFHQLDGHKSPPPADMLTELARVIGDRRDHPTPESYTCKLLAGGDNKILKKIGEESAEVVMACKDDDPEAIAGEVADLFYHTLVALAHHNVDLRAVYRKLGDRRR

SEQ ID NO: 13149 - protein, 455 aa, Geobacillus stearothermophilus
AIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVAL

SEQ ID NO: 13150 - protein, 415 aa, Saccharomyces cerevisiae
SLSSKLSVQDLDLKDKRVFIRVDFNVPLDGKKITSNQRIVAALPTIKYVLEHHPRYVVLASHLGQPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 13151 - protein, 173 aa, Pleurotus sp. 'Florida'
  misc_feature (134)..(134): Xaa can be any naturally occurring amino acid
ADGLHRLPLKKMPSTASNPSMEAAYLAEKYGGVQAQVPLMGAGGSGRRVPQSDLFRTQEEINGGHNVPLSNFMNAQYFSEITLGTPPQTFKVILDTGSSNLWVPSTKCTSIACFLHAKYDSSSSSTYKSNGTEXSIQYGSGSMEGFVSQDTLTIGDLKIPHQDSPEATKEPAL

SEQ ID NO: 13152 - protein, 493 aa, Neurospora crassa
MAHKNILDFDLPRTRRDSGIITPSLALNSFLEYFGNPDAPIRGAIVSVYQAGAWLGSASVGITSDRIGRRKAIAFGCVFGVLGGALMTGAAHVAMLIIGRILVGYAVGTITGVAPVFGAEIAKSKNQRSYPDELSRPHPKSWLRVTDLGVGEGKWHNPNQWRLGFAVQSIPALALGVGVLFIKESPRWLCLKSRHAEAEKAFRSYHHNGSNDEWCREEFRHLQANIAIELQARGCLSWAELLKAPAFRKRLFVGSFVWAAAMLSGISFIQYFQPAIYATLQYNQDQQLLISGLYGSVAPVTCLVSLLFVDRIGRKKILVFSASLLSLCYLIITIIAAVFPARPGFPTNEAAQRGLIACVFVVSANYSALLGPMTWIIPYIKSCPIMIAENITYEPKLGEANDWASWLTAHQIFFVLTNALCAIVFALVYPETRGKSLEDMSEIFGDIKRRTEPELDEVHSSPSGKKDSEISEYAIEKTESKYHRDRRSDIFRV

SEQ ID NO: 13153 - protein, 168 aa, Glycine max
MLVYQDLLTGDELLSDSFRYKEIENGMLWEVEGKWVVKGAVDVDIGANPSAEGGGEDEGVDDAAVKVVDIVDTFRLQEQPAFDKKQFVTFMKRFIKNLTPKLDAEQQELFKKHIEGATKYLLSKIKDFQFFVGESMGDDACLVFAYYKDGAADPTFLYFAYALKEVKC

SEQ ID NO: 13154 - protein, 446 aa, Salmonella typhimurium LT2
MQQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDELPQETRFLQLFNRRHFPFVLFVAAIWTCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 13155 - protein, 457 aa, Salmonella typhimurium LT2
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 13156 - protein, 474 aa, Salmonella typhimurium LT2
MSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 13157 - protein, 417 aa, Salmonella typhimurium LT2
MYTPLNWTTTQRHVAFACFTSWMLDAFDFFILVFVLSDLAEWFHASVSDVSIAIMLTLAVRPIGALLFGRMAEKYGRRPILMLNILFFTVFELLSAWSPTFMAFLIFRVMYGVAMGGIWGVASSLAMETIPDRSRGLMSGIFQAGYPCGYLFASVIFGLFYSMVGWRGMFLIGALPVVLLPYIWFKVPESPVWLAARARKENTALLPVLRKQWKLCLYLVLVMAFFNFFSHGTQDLYPTFLKMQHGFDPHLISIIAIFYNIAAMLGGIFYGTLSERIGRKKAIMIAAFLALPVLPLWAFSSGSFTIGLGAFLMQFMVQGAWGVVPTWLNELVPANARAVLPGFVYQLGNLLASVNATLQARIAETHGGNYGLAMAIVAGAVAILICVFVAFGRETRGVVISGTDSDALPESAISHRT

SEQ ID NO: 13158 - protein, 456 aa, Salmonella typhimurium LT2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 13159 - protein, 351 aa, Salmonella typhimurium LT2
MMSSNWVKNAINEINADHQRSADTHLIRLPLSAFPGIQLYLKDESTHPTGSLKHRLARSLFLYGLCNGWIKEGTPIIEASSGSTAISEAWFARLLGLPFIAVMPACTAKRKIEQIQFYGGHCHFVESACEIYAASERLAHELNGHYMDQFTYAERATDWRGNNNIADSIFRQMRNELHPVPRFIVMSAGTGGTSATIGRYIRCQGYDTQLMVVDPENSVFLPYWQDRDASLRSPVGSKIEGIGRPRVEPSFIPDVVDEMLRVPDAASVATAHWLETQLGRKVGASTGTNMWGALQLAARMREAGETGAIVTLLCDSGDRYLDTYYHPAWVSDHIGDLTPWSAAIAKLLTGD

SEQ ID NO: 13160 - protein, 292 aa, Salmonella typhimurium LT2
MKLGFIGLGIMGSPMAINLARAGHQLHVTTIGPVADELLSLGAVNVETARQVTEFADIIFIMVPDTPQVEDVLFGEHGCAKTSLQGKTIVDMSSISPIETKRFAQRVNEMGADYLDAPVSGGEIGAREGTLSIMVGGEQKVFDRVKPLFDILGKNITLVGGNGDGQTCKVANQIIVALNIEAVSEALVFASKAGADPVRVRQALMGGFASSRILEVHGERMINRTFEPGFKIALHQKDLNLALQSAKALALNLPNTATCQELFNTCAANGGSQLDHSAMVQALELMANHKLS

SEQ ID NO: 13161 - protein, 441 aa, Salmonella typhimurium LT2
MTQYQALIIGFGKAGKTLAATLAKTGWRVAIIEQSASMFGGTCINIGCIPTKTLVHDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITRILQEKGVELILNANVQAVSSKEGAVQVETPEGAHLVDALLVASGRKPATAGLQLQNAGVAVNERGGIIVDDYLRTTADNIWAMGDVTGGLQFTYISLDDFRIVRDGLLGDGKRSTRDRQNVPYSVFMTPPLSRVGLTEEQARASGATVQVVTLPVAAIPRARVMNDTRGVLKAVVDVNTQRIVGVSLLCVDSHEMINIVKTVMDADLPYTVLRDQIFTHPTMSESLNDLFSLIK

SEQ ID NO: 13162 - protein, 347 aa, Salmonella typhimurium LT2
MNETPLRLLEMLTQTREDLWRAAQALTERGVTRIILTGSGTSYHGALTARTFMQRWCALPVDVCWPFMLDDETLARSGKALVVGISQGGGSLSTLAAMERARNVGHITASMAGVAPATIDRAADYILTVPCGEETAGAKTKGYHCTVLNLMLLALAVAGQQQRLDGEQRRSLLLRMEKTFNHLPALVTASQAWAQTNALALRDSADIRLTGPATLFGTVQEGALKMLETLRCPVSGYEFEEFIHGIYNAFNAQSALIMLDPQPDARQDRLAQILGEWTPSIYRIGPQVENNGLNLNFPFVNDEDFAVFEYIIPLQMLCAILPPQKGINPAIPKDPQFHQKMKSKQEI

SEQ ID NO: 13163 - protein, 250 aa, Salmonella typhimurium LT2
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPLKHYYLGNADEIAAKAAAVANQGKAK

SEQ ID NO: 13164 - protein, 408 aa, Salmonella typhimurium LT2
MSLSVTRENFDEWMVPVYVPAPFIPVRGEGSRLWDQQGKEYIDFAGGIAVNALGHAHPALREALNEQANRFWHIGNGYTNEPALRLAKKLIDATFAERVFFCNSGAEANEAALKLARKYAHDRVGNHKSGIVAFKNAFHGRTLFTVSAGGQPTYSQDFAPLPPDIRHAAYNDLNSASALIDDNTCAVIVEPVQGEGGVIPATKAFLQGLRELCDRHQALLIFDEVQTGVGRTGELYAYMHYGVTPDILTTAKALGGGFPIGAMLTTQDYASVMTPGTHGTTYGGNPLATAVAGKVLDIINTPEMQNGVRQRHDAFIERLNTLNVRFGMFSEIRGLGLLLGCVLQTEFAGKAKLIAQEAAKAGVMVLIAGGDVVRFAPALNVSDEEIATGLDRFALACERLQTGGVPCG

SEQ ID NO: 13165 - protein, 457 aa, Salmonella typhimurium LT2
MQKYTSEARQLLALRIPVILAQVAQTAMGFVDTVMAGGYSATDMAAVAIGTSIWLPAILFGHGLLLALTPVIAQLNGSGRRERIAHQVRQGFWLAGFVSVLVMIVLWNAGYIIRSMHNIDPALADKAVGYLRALLWGAPGYLFFQVARNQCEGLAKTKPGMVMGFLGLLVNIPVNYIFIYGHFGMPELGGIGCGVATAAVYWVMFIAMLSYIKHARSMRDIRNEKGFGKPDSVVMKRLIQLGLPIALALFFEVTLFAVVALLVSPLGIVDVAGHQIALNFSSLMFVLPMSLAAAVTIRVGYRLGQGSTLDAQTAARTGLGVGICMAVVTAIFTVTLRKHIALLYNDNPEVVALAAQLMLLAAVYQISDSIQVIGSGILRGYKDTRSIFFITFTAYWVLGLPSGYILALTDLVVDRMGPAGFWMGFIIGLTSAAVLMMLRMRYLQRQPSAIILQRAAR

SEQ ID NO: 13166 - protein, 365 aa, Salmonella typhimurium LT2
MSSAKLFTPLKVGAITATNRVFMAPLTRLRSIEPGDIPTPLMAEYYRQRASAGLIISEATQISAQAKGYAGAPGLHSDEQIAAWKKITQGVHAQGGHMAVQLWHTGRISHASLQPGGQAPVAPSAINAGTRTSLRDENGQAIRVETSTPRALDTHEIPGIVNDFRQAIANAREAGFDLVELHSAHGYLLHQFLSPSSNHRTDRYGGGVENRARLVLEVVDAGIKEWGADRIGIRLSPVGTFQNVDNGPNEEADALYLIEALGKRGIAYLHMSEPDWAGGEPYSDAFREKVRARFHGPIIGAGAYTPEKAEDLIEKGLIDAVAFGRDYIANPDLVARLQRKAELNPQRPESFYGGGAEGYTDYPTL

SEQ ID NO: 13167 - protein, 308 aa, Salmonella typhimurium LT2
MARAMDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 13168 - protein, 1015 aa, Salmonella typhimurium LT2
  misc_feature (196)..(196): Xaa can be any naturally occurring amino acid
MDVSRRQFFKICAGGMAGTTVAALGFTPKMALAQARNYKLLRAKEIRNSCTYCSVGCGLLMYSLGDGAKNAKEAIYHIEGDPDHPVSRGALCPKGAGLLDYVHSEDRLRYPEYRAPGSDKWQRISWDDAFTRIAKLMKADRDANFIEKNEQGVTVNRWLSTGMLCASAASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLLYLIENNKINAEYVKHYTNASLLVRDDFAFDDGLFSGYDAQKRQYDKSSWNYQFDENGYAKRDETLTHPRCVWNLLKQHVSRYTPDVVENICGTPKADFLKVCEVLASTSVPDRTTTFLYALGWTQHTVGAQNIRTMAMIQLLLGNMGMAGGGVNALRGHSNIQGLTDLGLLSTSLPGYLTLPSEKQADLQTYLAANTPKATLADQVNYWGNYPKFFVSLMKSFYGDAAQQENDWGFAWLPKWDQSYDVIKYFNMMDSGKVTGYFCQGFNPVASFPDKNKVVQSLSKLKYLVVIDPLVTETSTFWQNHGESNDVDPTTIQTEVFRLPSTCFAEEDGSIANSGRWLQWHWKGQDAPGEARNDGEILAGIYHRLREMYRAEGGKGAEPLLKMSWNYKQPDEPHSEEVAKENNGYALEDLYDANGTLLARKGQLLSSFALLRDDGTTSSSCWIYTGSWTEQGNQMSRRDNADPSGLGNTLGWAWAWPLNRRVLYNRASADPQGKPWDPKRMLIQWNGAKWTGNDIPDFNNAAPGSGTNPFIMQPEGLGRLFAIDKMAEGPFPEHYEPMETPLGTNPLHPNVVSNPAARLYEEDALRMGKKEQFPYVGTTYRLTEHFHTWTKHALLNAIAQPEQFVEISETLAAAKGIANGDYVKVSSKRGFIRAVAVVTRRLRTLHVNGQQVETVGIPIHWGFEGVARKGYIANTLTPNVGDANSQTPEYKAFLVNIEKA

SEQ ID NO: 13169 - protein, 481 aa, Salmonella typhimurium LT2
MTIWENAMQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 13170 - protein, 210 aa, Salmonella typhimurium LT2
MILHPSLASADPLRYAEALTALHDAPLGSLHLDIEDTSFINNITFGMKTIQAVAQYTRHPLSFHLMVSSPQRWLPWLAAIRPGWIFIHAESVQNPPEILADIRAIGAKAGLALNPATPLLPYRYLALQLDALMIMTSEPDGRGQQFIAAMCEKVSQGREHFPAAECWADGGITLRAARLLAAAGAQHLVIGRALFTTANYDVTLSQFTAL

SEQ ID NO: 13171 - protein, 372 aa, Salmonella typhimurium LT2
MKSRAAVAFGPGQPLKIVEIDVAPPKKGEVLVKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPVYHYMGTSTFSEYTVCAEISLAKVNPQAPLDKVCLLGCGVTTGIGAVHNTAKVKAGDTVAVFGLGGIGLAVIQGAVQAKAGRILAVDTNPEKFTLAGEMGATDFINPNDYDKPIQDVIVELTDGGVDFSFECIGNVNVMRAALECCHKGWGESIIIGVAGAGQEIKTRPFQLVTGRVWRGSAFGGVKGRTQLPGMVEDAMNGKIRLDPFITHRLPLEQINDAFELMHQGKSIRTVIHFGDN

SEQ ID NO: 13172 - protein, 243 aa, Salmonella typhimurium LT2
MALLKLKEISKEYSGKKVLDTVSLKIQSGDMKVVMGPSGCGKTTLLRCLLRLEEPDYGNIYFHGKNIYDKEFTILEFRKKVGCVFQNYALYRHLNVMDNITLALCKVFGMPGQLAREKALHELQKLDMASHSAKYPSQLSGGQQQRVALARTMVTDPELIIFDEPTSALDPLMTREVGMLIKQLHDNGVTILCVTHDIRLARLLSDNVTFLNHGKIRAEGAFTDLALRETDPDIHCFFSEAQR

SEQ ID NO: 13173 - protein, 268 aa, Salmonella typhimurium LT2
MERYENLFAQLNDRREGAFVPFVTLGDPGIEQSLKIIDTLIDAGADALELGVPFSDPLADGPTIQNANLRAFAAGVTPAQCFEMLALIREKHPTIPIGLLMYANLVFNNGIDAFYARCEQVGVDSVLVADVPVEESAPFRQAALRHNIAPIFICPPNADDDLLRQVASYGRGYTYLLSRSGVTGAENRGALPLHHLIEKLKEYHAAPALQGFGISSPEQVSAAVRAGAAGAISGSAIVKIIEKNLASPKQMLAELRSFVSAMKAASRA

SEQ ID NO: 13174 - protein, 267 aa, Salmonella typhimurium LT2
MAEPLTVSPELTANYAYFFDLDGTLAEIKPHPDQVVVPHKILQLLDRLAAHNAGALALISGRSMTELDALAKPFRFPLAGVHGAERRDINGKTHIVRLPEAVVREVEALLRSTLVALPGTELESKGMAFALHYRQAPEHEAALLALAQHVTQHWPQLALQPGKCVVEIKPKGTNKGEAIAAFMQEAPFAGRIPVFVGDDLTDEAGFGVVNHAGGISVKVGVGATQAAWRLESVPDVWRWLEQINYPQQEQQVMNNRRDGYESFSRSI

SEQ ID NO: 13175 - protein, 250 aa, Salmonella typhimurium LT2
MSAIEVTNLVKKFHGQTVLHGIDLEVKPGEVVAIIGPSGSGKTTLLRCINLLEQPEAGTIKVGDIIIDTARPFSQQKGLIRQLRQHVGFVFQSFNLFPHRTVLENIIEGPVIVKGEPKAEATALARELLAKVGLAGKESRYPRRLSGGQQQRVAIARALAMRPEVILFDEPTSALDPELVGEVLNTIRQLAQEKRTMVIVTHEMSFARDVADRAIFMDQGQIVEQGPAKTLFADPQHPRTRQFLEKFLVK

SEQ ID NO: 13176 - protein, 328 aa, Salmonella typhimurium LT2
MPLHHLTRFPRLEFIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 13177 - protein, 264 aa, Salmonella typhimurium LT2
MNDSLKAQCGAEFLGTGLFLFFGIGCLSALKVAGASLGLWEICIIWGLGISLAVYLTAGISGGHLNPAVTIALWLFACFPKQKVLPYIIAQFAGAFGGALLAYVLYSSLFTEFETAHHMVRGSVESLQLASIFSTYPAAALNVWQAALVEVVITSILMGMIMALTDDGNGIPKGPLAPLLIGILVAVIGASTGPLTGFAMNPARDFGPKLFTWLAGWGNMAMSGGREIPYFIVPIVAPVIGACAGAAIYRYFIGKNLPCNRCEL

SEQ ID NO: 13178 - protein, 203 aa, Salmonella typhimurium LT2
MLTEQQRRELDWEKTDGLMPAIVQHAVSGEVLMLGYMNPQALDKTIESGHVTFFSRTKQRLWTKGETSGHVLNVVSIAPDCDNDTLLVLANPVGPTCHKGTSSCFGDASHQWLFLYQLEQLLAERKTADPTSSYTAKLYASGTKRIAQKVGEEGVETALAATVNDRFELTNEASDLMYHLLVLLQDQDLNLTTVIDNLRKRHQ

SEQ ID NO: 13179 - protein, 479 aa, Salmonella typhimurium LT2
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTAGDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRPWGKYNVIDSGKNYLVRCITVKPGEKFVAQMHHHRAEHWIVLSGTARVTKGEQTYMVSENESTFIPPNTIHALENPGMTPLKLIEIQSGTYLGEDDIIRLEQRSGFSKEWTNERS

SEQ ID NO: 13180 - protein, 413 aa, Salmonella typhimurium LT2
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCEVGGSLSLAQLKAEYRAVLMTVGMSCGSGLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDTFAEIKAQHNIIDTHNYQTDDPAIFAAGDIVKGDKTVVYAVKTGKEAAQAIHHYLEEACSC

SEQ ID NO: 13181 - protein, 258 aa, Salmonella typhimurium LT2
MMSENKLHVIDLHKRYGGHEVLKGVSLQARAGDVISIIGSSGSGKSTFLRCINFLEKPSEGAIIVNGQNINLVRDKDGQLKVADKNQLRLLRTRLTMVFQHFNLWSHMTVLENVMEAPIQVLGLSKHDARERALKYLAKVGIDERAQGKYPVHLSGGQQQRVSIARALAMEPDVLLFDEPTSALDPELVGEVLRIMQQLAEEGKTMVVVTHEMGFARHVSSHVIFLHQGKIEEEGDPEQVFGNPQSPRLQQFLKGSLK

SEQ ID NO: 13182 - protein, 468 aa, Salmonella typhimurium LT2
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVYMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 13183 - protein, 365 aa, Salmonella typhimurium LT2
MSIEIARIKKSFGRTQVLNDISLDIPSGQMVALLGPSGSGKTTLLRIIAGLEHQSSGHIRFHGTDVSRLHARERKVGFVFQHYALFRHMTVFDNIAFGLTVLPRRDRPTAAAIKTKVTQLLEMVQLAHLADRFPAQLSGGQKQRVALARALAVEPQILLLDEPFGALDAQVRKELRRWLRQLHEELKFTSVFVTHDQEEATEVADRVVVMSQGNIEQADAPDRVWREPATRFVLEFMGEVNRLTGTVRGGQFHVGAHRWPLGYTPAYQGPVDLFLRPWEVDISRRTSLDSPLPVQVIEASPKGHYTQLVVQPLGWYHDPLTVVMAGEDVPVRGERLFVGLQKARLYNGDQRIETREEELALAQSA

SEQ ID NO: 13184 - protein, 171 aa, Salmonella typhimurium LT2
MDYFTLFGLPARYQIDTQALSLRFQDLQRQYHPDKFANGTQAQQLAAVQQSATINQAWQTLRHPLTRAEYLLSLHGFDLASEQHTVRDTAFLMEQLTLREELDDIEQSKDDARLESFIKRVQKMFDARLQQMVEQLDNAAWDAAADTVRKLRFLDKLRSSAEQLEEKLLDF

SEQ ID NO: 13185 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 13186 - protein, 307 aa, Salmonella typhimurium LT2
MTTGTDFHVGIVGLGSMGMGAARSCLRAGLSTWGADLNPQACANLLAEGACGAAASAREFAGVVDALVILVVNAAQVRQVLFGEDGVAHLMKPGSAVMVSSTISSADAQEIAAALTALNLNMLDAPVSGGAVKAAQGEMTVMASGSEAAFTRLKPVLDAVASNVYRISDTPGAGSTVKIIHQLLAGVHIAAAAEAMALAARAGIPLDVMYDVVTHAAGNSWMFENRMQHVVDGDYTPRSAVDIFVKDLGLVADTAKALRFPLPLASTALNMFTSASNAGYGKEDDSAVIKIFSGITLPGVTPEEPSC

SEQ ID NO: 13187 - protein, 472 aa, Salmonella typhimurium LT2
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 13188 - protein, 477 aa, Salmonella typhimurium LT2
MRKLTLPKDFLWGGAVAAHQVEGGWNKDGKGPSICDVLTGGAHGVPREITQNVVAGKYYPNHEAVDFYGHYKEDIRLFAEMGFKCFRTSIAWTRIFPNGDESQPNEAGLKFYDDMFDELLKYNIEPVITLSHFEMPLHLVQHYGGWTNRKVVDFFVRFAEVVFERYKHKVKYWMTFNEINNQRNWRAPLFGYCCSGVVYTEHENPEETMYQVLHHQFVASALAVKAARRINPQMKVGCMLAMVALYPFSCKPEDVMFAQESMRERYVFTDVQLRGYYPSYVLNEWERRGFNIKMEDGDLEVLREGTCDYLGFSYYMTNAVKAEGGSGDAISGFEGSVPNPYVKASDWGWQIDPVGLRYSLCELYERYQKPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 13189 - protein, 494 aa, Salmonella typhimurium LT2
MSDVTLLAEVTTFLRQRHGQFIAGERQAGNGTNFSVTNPATGKIIADVVSATPAQAEEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 13190 - protein, 395 aa, Salmonella typhimurium LT2
MTDKQLDTKLVNAGRSKKYTLGSVNSVIQRASSLVFDTVEAKKHATRNLANGELFYGRRGTLTHFSLQEAMCELEGGAGCALFPCGAAAVANTILAFVEQGDHILMTNTAYEPSQDFCSKILGKLGVTTSWFDPLIGADITQHIQPNTKVVFLESPGSITMEVHDIPSIVSAVRRVAPEAVIMIDNTWAAGVLFKALEFDIDISIQAGTKYLIGHSDAMVGTAVANARCWEQLRENAYLMGQMLDADTAYMTSRGLRTLGVRLRQHQESSLKIAAWLANHPQVARVNHPALPGSKGHAFWKRDFTGSSGLFSFVLNKKLTEAELSAYLDNFSLFSMAYSWGGYESLIIANQPEQIAAIRPAGGVDFTGTLVRVHIGLESVDDLIADLAAGFARIV

SEQ ID NO: 13191 - protein, 429 aa, Salmonella typhimurium LT2
MKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 13192 - protein, 472 aa, Salmonella typhimurium LT2
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDITGVRQTDKRVAIIGAGPAGLACADVLTRNGVKAVVFDRHPEIGGLLTFGIPAFKLEKEVMTRRREIFTGMGIEFKLNTEVGRDVQLEDLLKDYDAVFLGVGTYQSMRGGLENEDADGVFDALPFLIANTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVVPADAVVMAFGFRPHSMEWLAKHSVELDSQGRIIAPERSDNAFQTSNPKIFAGGDIVRGSDLVVTAIAEGRKAADGIMNYLEV

SEQ ID NO: 13193 - protein, 405 aa, Salmonella typhimurium LT2
MATEQTAITRATFDEVILPVYAPADFIPVKGKGSRVWDQQGKEYIDFAGGIAVTALGHCHPALVEALKSQGETLWHTSNVFTNEPALRLGRKLIDATFAERVLFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVQAATPEFLKGLRDLCDEHQALLVFDEVQCGMGRTGDLFAYMHYGVTPDILTSAKALGGGFPVSAMLTTQEIASAFHVGSHGSTYGGNPLACAVAGAAFDIINTPEVLQGIHTKRQQFVQHLQAIDEQFDIFSDIRGMGLLIGAELKPKYKGRARDFLYAGAEAGVMVLNAGADVMRFAPSLVVEEADIHEGMQRFAQAVGKVVA

SEQ ID NO: 13194 - protein, 190 aa, Salmonella typhimurium LT2
MLKSTLAAVAAVFALSALSPAALAAKGDPHVLLTTSAGNIELELNSQKAPVSVKNFVDYVNSGFYNNTTFHRVIPGFMIQGGGFNEQMQQKKPNPPIKNEADNGLRNTRGTIAMARTADKDSATSQFFINVADNAFLDHGQRDFGYAVFGKVVKGMDVADKISQVPTHDVGPYQNVPTKPVVILSAKVLP

SEQ ID NO: 13195 - protein, 450 aa, Salmonella typhimurium LT2
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPEIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKFQNTNVEGIYAVGDNTGAVELTPVAVAAGRRLSERLFNNKPEEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 13196 - protein, 309 aa, Salmonella typhimurium LT2
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGQQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 13197 - protein, 512 aa, Salmonella typhimurium LT2
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 13198 - protein, 460 aa, Salmonella typhimurium LT2
MRYRFPDNFWWGSACSALQTEGDSLNGGKSQTTWDVWFERQPGRFHQGVGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 13199 - protein, 298 aa, Salmonella typhimurium LT2
MAVIAFIGLGQMGSPMASNLLKQGHQLSVFDVNPDAVQRLVDKGAQPASSPAQATIGAEFVITMLPNGDLVRSVLFGEQGVCETLSREALVIDMSTIHPLQTDNLIADMQSKGFSMMDVPIGRTSDNAITGTLLLLAGGTAEQVERATPVLMAMGNELVNTGGPGMGIRVKLINNYMSIALNALSAEAAVLCEALGLSFDVALKVMSGTAAGKGHFTTTWPNKVMKGDLSPAFMIDLAHKDLGIALDVANQLHVPMPLGAASREVYNLARAAGRGREDWSAILEQVRISAGLTANVKK

SEQ ID NO: 13200 - protein, 309 aa, Salmonella typhimurium LT2
MPLEKGIAELVAGFIAAGRPSSREQNIDDRRAGYIASTTLAGETETRVQVEDIELDAMTFRVVSPLNATGKLPCIIYYHGGCFVSGGFATHDNQLRQLAFYSRCRVIAAQYRLAPDHTFPAAHNDAETGANTIWKYAQKLGIDRENITLAGDSAGGHLALVTALRLKAARQWQPAQLILIYPMLDATARFASYTCNGLDYIITRDTLLSGYEMYMPRTDPLHPEASPLWREDFAGLPSTHIITAEFDPLRDEGEALYQRFQEQGVECTCQRYLGVIHGFFQLGGVSQAARSAMRDVAWRVVSPSTGKMT

SEQ ID NO: 13201 - protein, 1016 aa, Salmonella typhimurium LT2
  misc_feature (196)..(196): Xaa can be any naturally occurring amino acid
MQVSRRQFFKICAGGMAGTTAAALGFAPGVALAETRQYKLLRTRETRNTCTYCSVGCGLLMYSLGDGAKNAKASIFHIEGDPDHPVSRGALCPKGAGLVDFIHSESRLKFPQYRAPGSDKWQQISWEEAFDRIAKLMKEDRDANYQAQNAEGVTVNRWLTTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTASVADFYAPIRSGTDIAFLSGVMLYLLTNEKYNREYTEAYTNASLIVREDFGFDDGLFTGYDADKRQYDKTSWHYELDENGFAKHDTTLQHPRCVWNLLKQHVSRYTPDMVENICGTPKADFLKVCEYIAETSAKDKTASFLYALGWTQHSIGAQNIRTMAMIQLLLGNMGMAGGGVNALRGHSNIQGLTDLGLLSQSLPGYLTLPSEKQTDLQTYLAANTPKPLLKDQVNYWGNYPKFFVSMMKAFFGDKATAENSWGFDWLPKWDKGYDVLQYFEMMKQGKVNGYICQGFNPVASFPNKNKVVASLSKLKYLVTIDPLNTETSTFWQNHGESNDVDPAKIQTEVFRLPSTCFAEENGSIVNSGRWLQWHWKGADAPGIAMTDGEILAGIFLRLRKMYSEQGGANPEQVLNMTWNYTKPYEPASEEVAMESNGKALADLIDPATGAVVVKKGQQLSSFAQLRDDGTTSSGCWIFAGSWTPEGNMMARRDNADPSGLGNTLGWAWAWPLNRRILYNRASADPQGNPWDPKRQLLKWEGGKWAGWDIPDYSAAAPGSDVGPFIMQPEGMGRLFAIDKMAEGPFPEHYEPFETPLGTNPLHPNVISNPAARIFKDDADALGKADKFPYVGTTYRLTEHFHYWTKHALLNAIAQPEQFVEIGEKLANKLGIAHGDTVKVSSNRGYIKAKAVVTKRIRTLKADGKDIDTIGIPIHWGYEGVAKKGFIANTLTPFVGDANTQTPEFKSFLVNVEKV

SEQ ID NO: 13202 - protein, 319 aa, Salmonella typhimurium LT2
MKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 13203 - protein, 313 aa, Salmonella typhimurium LT2
MLAVITRLFPLWALLLSLTAYYTPSTFTPVGPWVATLLMLIMFGMGVHLNVDDFKRVLSRPAPVAAGIFLHYLVMPLAAWLLALLFKMPPDLSAGMVLVGSVASGTASNVMIYLAKGDVALSVTISSVSTLVGVVATPLLTRLYVDAHIQVDVMGMLLSILQIVVIPITLGLVIHHLFPRVVKVVKPYLPAFSMVCILAIISAVVAGSASHIASVGFMVIIAVILHNTLGLLGGYWGGRLFGFDESTCRTLAIEVGMQNSGLAAALGKIYFGPLAALPGALFSVWHNLSGSLLAGYWSGKPIVEKSGETAKVN

SEQ ID NO: 13204 - protein, 327 aa, Salmonella typhimurium LT2
MATRIEFHKHGGPEVLQTVEFTPAEPAEHEIQVENKAIGINFIDTYIRSGLYPPPSLPAGLGTEAAGVVSKVGNGVEHIRVGDRVVYAQSTLGAYSSVHNVTADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 13205 - protein, 449 aa, Salmonella typhimurium LT2
MSTPSARTGGSLDAWFKISQRGSTVRQEVVAGLTTFLAMVYSVIVVPGMLGKAGFPPAAVFVATCLVAGVGSIVMGLWANLPLAIGCAISLTAFTAFSLVLGQHISVPVALGAVFLMGVLFTVISATGIRSWILRNLPQGVAHGTGIGIGLFLLLIAANGVGLVIKNPLDGLPVALGDFDTFPVIMSLVGLAVILGLEKLKVPGGILLTIIGISIVGLLFDPNVHFSGIFAMPSLSDENGNSLIGSLDIMGALNPVVLPSVLALVMTAVFDATGTIRAVAGQANLLDKDGQIIDGGKALTTDSLSSVFSGLVGAAPAAVYIESAAGTAAGGKTGLTAITVGVLFLLILFLSPLSYLVPVYATAPALMYVGLLMLSNVAKIDFADFVDAMAGLVTAVFIVLTCNIVTGIMIGFATLVVGRLVSGEWRKLNIGTVVIAVALVAFYAGGWAI

SEQ ID NO: 13206 - protein, 469 aa, Salmonella typhimurium LT2
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLLIGKKRMAGMR

SEQ ID NO: 13207 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 13208 - protein, 478 aa, Salmonella typhimurium LT2
MSQRSKYNSAYVYVLCCIAALAGLMFGYSTAVITGVVLPLQQYYQLTPTETGWAVSSIVIGCIIGALVGGKIADKLGRKPALLIIAIIFIASSLGAAMSESFMIFSLSRIVCGFAVGMAGTASTMYMSELAPAEIRGKALGIYNISVVSGQVIVFIVNYLIAKGMPADVLVSQGWKTMLFAQVVPSIAMLAITLFLPESPAWCARNNRSEARSIKVLTRIYSGLTATDVAAIFDSMKETVRSQDNVAGGERTNLKSSPVLRYILLVGCCIAVLQQFTGVNVMNYYAPLVLQNSSTEVVMFQTIFIAVCNVVGSFIGMILFDRYGRIPIMKIGTIGSIVGLLIASYGLYTHDTGYITIFGILFFMLLFAVSWSVGAWVLISEVFPEKIKGFGMGLAVSLMWIANFLISLLFPVINDNAWLQETFGGAFSMWIFVVFNLVCYVFISRYVPETKGVPLTEIERLAENKLREIQGKRRDVIA

SEQ ID NO: 13209 - protein, 316 aa, Salmonella typhimurium LT2
MSMNKAVSSEQKPLDVICLGRVAVDLYGQQIGSRLEDMTTFAKYLGGSSGNVAYGTAIQGLRSAMLARVGDEHMGRFVREELNRVGVDTQCLLSDRDRLTALVILGIKDQDTFPLIFYRDNCADMALTPEDIREDYIASSRALAVTGTHLSHPNTRAAVLKALEYAQKHGLRRALDIDYRPVLWGLTSLGDGETRFIASSQVTEQLQQVLRHFDLIVGTEEEFHIAGGSTDTLTALRRVRQLTQAVLVCKRGALGCSVFEGNIADDWSQVKIHSGVRVDVLNVLGAGDAFMSGLLRGYLNDESWEQACRYATPAAR

SEQ ID NO: 13210 - protein, 339 aa, Salmonella typhimurium LT2
MTIIKSYAAKEAGGELELYEYDAGELQPEDVEVRVDYCGICHSDLSMIDNEWGFSQYPLVAGHEVIGRVAALGSAAQDKGLKVGQRVGIGWTARSCGHCDACISGNQINCQEGAVPTILNRGGFAEKLRAGWQWVIPLPENIDMASAGPLLCGGITVFKPLLMHHITATSRVGVIGIGGLGHIAIKLLHAMGCEVTAFSSNPSKEQEVLAMGANNVVNSRDPEALKALAGQFDLIINTVNVDLDWQPYFEALTYGGNFHTVGAVLKPLPVPAFTLIAGDRSISGSATGTPYELRKLMKFAGRSKVAPTTELFAMSQINEAIQHVRDGKARYRVVLKADF

SEQ ID NO: 13211 - protein, 460 aa, Salmonella typhimurium LT2
MAKAPKRAFVCNECGADYPRWQGQCSACHAWNTITEVRLAASPTVARNERLSGYAGSAGVSKVQKLSDISLEELPRFSTGFKEFDRVLGGGVVPGSAILIGGNPGAGKSTLLLQTLCKLAEQMKTLYVTGEESLQQVAMRAHRLGLPTANLNMLSETSIEQICLIAEEEQPKLMVIDSIQVMHMADIQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMSDQDVFVNVVGGVKVTETSADLALLLAMVSSLRDRPLPQDLVVFGEVGLAGEIRPVPSGQERISEAAKHGFRRAIVPAANVPKKPPEGMLVFGVKKLADALSVFDDL

SEQ ID NO: 13212 - protein, 474 aa, Cylicomorpha parviflora
MSPQTETKASVGFKAGVKDYKLTYYTPDYQTKDTDILAAFRVTPQPGVPPEEAGAAVAAESSTGTWTTVWTDGLTSLDRYKGRCYNIEPVPGEESQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIFFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAVDT

SEQ ID NO: 13213 - protein, 474 aa, Jacaratia corumbensis
MSPQTETKASVGFKAGVKDYKLTYYTPDYQTKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFIEKDRSRGIFFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAVDT

SEQ ID NO: 13214 - protein, 465 aa, Moringa longituba
SAGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRLSGGDHIHSGTVVGKLEGEREITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAVDT

SEQ ID NO: 13215 - protein, 387 aa, Salmonella enterica subsp. enterica serovar Typhi
MPQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDEPPQETRFLQLFNRRHFPFVLFVAAIWSCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVST

SEQ ID NO: 13216 - protein, 210 aa, Salmonella enterica subsp. enterica serovar Typhi
MILHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAVECWADGGITLRAARLLAAAGAQHLVIGRALFTTANYDVTLSQFTAL

SEQ ID NO: 13217 - protein, 470 aa, Salmonella enterica subsp. enterica serovar Typhi
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLKAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 13218 - protein, 466 aa, Salmonella enterica subsp. enterica serovar Typhi
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 13219 - protein, 450 aa, Rhodococcus sp. RHA1
MNPSTTPESWASPRHRSAVTWVVAIATIAIIFDGYDLVVYGTILPTLMNDPGELGEISAQQAGALGSYALIGVMVGALTAGAVGDYLGRRRMMLVNIVWFSIGMGLAALATNVTMFGLLRFFTGIGVGGLVATAGAMVAEFAPPGKRNLYNAIVYSGVPAGGVLASLLAIVLRDTIGWRGLFWIGALPIVILLPLALVKLPESPKWLVARGHEDKARRISERTGIPMPDADEIAAERASVEKVGFAALATRRYAWGTALLGMMSFSGLLLTYGLNTWLPKIMEDAGFNAKGSLSFLLVLNGGAILGGLIASKVADGIGPQRVVATTFGLAALALILLTLGFPLPVLLASVAVAGVGTIGTQVLIYGFVSNYYSTSARGAGVAWCAGFGRLGGIFGPLIGGALISAGISSQVAFYVFAGIAVLGGIVTFFVPRARVTRAAPAAAYSTVQVS

SEQ ID NO: 13220 - protein, 288 aa, Raphanus sativus
DEFMNEVTLIARLQHINLVQILGCCIDADEKILIYEYLENLSLDSYLFGKTQSPKLNWKERFDITSGVARGLLYLHQDSRFRIIHRDLKVSNILLDKNMIPKISDFGMARIFARDETEASTMKVVGTYGYMSPEYAMNGIFSEKSDVFSFGVIVLEIVTGTRNRGFYNLNYKNNFLSYAWSNWREGRALEIVDPVILDSLSPLTLTFQRQEVLKCIQIGLLCVQELAEDRPTMSTVVWMLGSEATEIPQPKPPDYCVGKSPYETASKQLDDDESWTVNQYTCSVIDAR

SEQ ID NO: 13221 - protein, 288 aa, Raphanus sativus
DEFMNEVTLIARLQHINLVQIIGCCIEADEKILIYEYLENLSLDSYLFGKTQRPKLNWKERFNITNGVARGLLYLHQDSRFRIIHRDLKVSNILLDKNMTPKISDFGMARTFTRDETEANTMKVVGTYGYMSPEYAMYGKFSEKSDVFSFGVIVLEIVSGKKNRGFNYGNNLLSYAWSHWKEGRALGIVDPVIIDSLPSLPLKFGQEEVLKCIQIGLLCVQELAEDRPTMSSVVWMLGSEATEIPQPKPPCHCFERSPYELDPSLSRQCYDDESWTVNQYTCSLIDAR

SEQ ID NO: 13222 - protein, 291 aa, Raphanus sativus
DEFMNEVTLVARLQHVNLVQILGCCIDADEKMLIYEYLENLSLDSYLFGENRRSKLNWKERFDITNGVARGLLYLHQDSRFRIIHRDLKVSNILLDKNMTPKISDFGMARIFAREETEANTMKVVGTYGYMSPEYAMHGIFSEKSDVFSFGVIILEIITGKRNRGFYNLNYENDLLSYAWSNWKEGRALEIVDPVIIDSFSPLSSTYQPQEVLKCIQIGLLCVQDLAENRPTMSFVVWMLGNEATEIPQPKWPGYCVRRSPYELDPSSSRQCDDDESWTVNQYTCSVIDAR

SEQ ID NO: 13223 - protein, 291 aa, Raphanus sativus
DEFMNEVRLVARLQHINLVRILGCCIDADEKMLIYEYLENSSLDSFLFGKKRSSNLNWKDRFDITNGVARGLLYLHQDSRFRIIHRDMKVSNILLDKNMIPKISDFGMARIFAREETEANTKKVVGTYGYMSPEYAMNGIFSEKSDVFSFGVIVLEIVSGKRSRGFYNLNHENNLLSYAWSHWTEGTALEIVDPIIIDSSSSLPSTFQKKEALKCIQIGLLCVQERAEHRPTMSSVVWMLGSEATEIPKPNPPGYYVGRCSYENNPSSSRLCDDYESWTVNQYTCSVIDAR

SEQ ID NO: 13224 - protein, 289 aa, Raphanus sativus
DEFMNEVTLVARLQHKNLVQILGCCIDANEKMLIYEYLENLSLDSYLFGKTRRPKLNWKERFDITNGVARGLLYLHQDSRFRIIHRDLKVSNILLDKNMIPKISDFGMARIFAREETEANTMNVVGTYGYMSPEYAMHGIFSEKSDVFSFGVIVLEIVTGKRNRGFNNLNYEHNLLNYAWSNWKEGRAIEIVDPDIVDSLSPLSSTFQPQVIKCIQIGLLCVQERAEHRPTMSSVVWMLGSEVTEIPQPKPPGYCVRSSYELDPSSSRQCDDDQSWTVNQYTCSVIDAR

SEQ ID NO: 13225 - protein, 291 aa, Raphanus sativus
DEFMNEVRLIARLQHINLVRILGCCIDADEKLLIYEYLENSSLDSYLFGKKRSCKLNWKHRFDITNGVARGLLYLHQDSRFRIIHRDMKVSNILLDKNMIPKISDFGMARIFGRDTSEASTRNVVGTYGYMSPEYAMYGVFSEKSDVFSFGVIVLEIVSGKRSRGFYQLNNDNNLLSYAWSHWTEGRALEIVDPVIVDSLSSLPSTSQPKEVLKCIQIGLLCVQERAEHRPTMSSVVWMLGSEATEIPQPKPPVYRLAKSFYANNPSSSRHCEDNESWTVNQYTCSVIDAR

SEQ ID NO: 13226 - protein, 288 aa, Raphanus sativus
DEFMNEVRLIARLQHINLVRILGCCIDADEKMLIYEYLENSSLDYFLFGKKRSSNLNWKDRFAITNGVARGLVYLHQDSRFRIIHRDMKAGNILLDKNMIPKISDFGLARIIARDQTEASTDNPIGTYGYMSPEYAMYGILSEKTDVFSFGVIVLEIVTGKRNRGFYQSTPEDNLVCYAWTHWAQGRALEIVDPVIVDSLSSTFQPKEVLKCIQIGLLCIQERAVHRPTMSSVVWMLGSEATAIPQPKPPVYCLIPSFYANNPSSSRPSDNDESWTMNEYTCSVIDAR

SEQ ID NO: 13227 - protein, 500 aa, Citrus sinensis
LLLIPLLLILKKLKAQNKQQLPPSPPKLPVIGNFHQLGELPHQSLWQLSKKYGPVMLLKLGRVPLVVISSAEAARDVLKVHDLDCCSRPPLIGSGKFTYNYSDIAFSPYSDYWRELRKISVLEVFSLRRVQSFGFIREEEVALLMNSISESSSSASPVDLSEKMFALTGSIVFRMAFGRRFRGSNFDNHSFQELVHAVESLLGGFAAAECFPYVGWIIDRLNGYHAKLERVFQELDTLFQQIIDDHLKPAETTKQEHVQQDIIDVMLKIERDQAESHESEAWLTKNHIKAVLLNIFLGGVDTSAITVIWAMAELCKNPRLMKKAQAEIRNHIGNKGRVTEADIDQLQYLKMVIKETLRLHPPAPLLIARDTLYRFKVNGYDIYPKTLIQVNAWAIGRDSKYWESPEEFIPERFIDKPVDVKGQDFEYLPFGSGRRICPGINLGLIMSELALANLLYCFDWKLPNGREEDCVNMNMEEATGVSLTLSKKTPLILVPVNYLQ

SEQ ID NO: 13228 - protein, 440 aa, Mycobacterium smegmatis
MDPVSQLEADARHLVRYSGRGGFTPTVIGSARGSLMFTEDGRELIDFTSGQMSAILGHSHPEIVATVQSQIAHLDHLYSGMLSRPVIELSRRLAETLPPTLDKVLLLSTGAESNEAAVRMAKLVTGKHEIVSFARSWHGMTQAAANATYSAGRRGYGPAAPGNFALPVPHRFRPDITDELGELDWRRQLDLGFDLIDAQSVGSLAACLIEPILSSGGIIELPPGYLAALAQKCREREMLLIVDEAQTGLCRTGDWYAFEHDGVVPDILTLSKTLGAGLPLAAVITSSEIEQRAQEREFLFFTTHVNDPLPAAVGLTVLDVLSRDRLDVRARELGQRLRAGLDELAGRHPIVADVRGRGLLLGMELSAEDTPGVSADQLGAVVTRRCFELGLHMNIVQLPGMGGTFRLAPPLTATDNEIDRALEIMDEALAYAREPAVHRS

SEQ ID NO: 13229 - protein, 209 aa, Oryza sativa
GGACGYGDLDIFRYGRYTAGVSGALFGRGSACGGCYEVRCVNHVLWCLRGSPTVVVTATDFCAPNLGLSDDYGGWCNFPKEHFEMSEAAFLRVAKAKADIVPVQFRRVNCDRPGGMSFTIPGGPSFLKVVIKKRGGERKVAAGKVKSLKPRVTPKEKEGGPELTVRRDLRGQPLSFEVTGGRGRTVVAYSVAPPDWMFAQTFEGKQFVE

SEQ ID NO: 13230 - protein, 376 aa, Wolbachia sp. wMelPop
  misc_feature (133)..(133): Xaa can be any naturally occurring amino acid
  misc_feature (136)..(136): Xaa can be any naturally occurring amino acid
  misc_feature (138)..(138): Xaa can be any naturally occurring amino acid
  misc_feature (185)..(185): Xaa can be any naturally occurring amino acid
VFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHXSKXGXADFAFNNDVEMLLKMREFFTFLPANNQESPKSAPICNDVDDIDESLXTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPF

SEQ ID NO: 13231 - protein, 222 aa, Brassica rapa subsp. pekinensis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIRISQTDQELDCAGHTEVCMLWKLKTNYIN

SEQ ID NO: 13232 - protein, 379 aa, Pseudomonas syringae pv. lachrymans
MLKPHGLTPLALTGGILVSLLSVSLSAHAEIATDVATTGWATQNGGTKGGSRAAANNIYTVKNAAELKAALAASGGSNGRIIKERGVIDVSDGKPYTKTSDMKQRARLDIPGKTTIVGTSSSAEIREGFFYAKENDVIIRNLTIENPWDPEPVWDPEDGSAGNWNSEYDGLTVEGASNVWIDHVTFTDGRRTDDQNGTANGRPKQHHDGALDVKNGANYVTISYSVFRNHEKNNLIGSSDSKTPDDGKLKVTNHNSLFENISSRGPRVRVGQVHLYNNHHIGSTTHKVYPCVYAQGVGKGSKIFSERNVLDISGISGCSKVAADYGGSVYRDSGSLVNGSVISCSWSTSIGWTPPYSYTPLAADKVAADVKAKAGAGKI

SEQ ID NO: 13233 - protein, 412 aa, Rhodococcus ruber
MIIIGAGQGGLQAAMSLRDHGYTGRLTIVGDEPGLPYQRPPLSKAYLINDDAMSEELLLLRPHSVFERLDIDLITGDGVTRIDRVRSTVSLSSGRELAFDHLILATGARPRELSVPGADLAGVEALRTCDDAKAIRAGLTGPARVVVIGGGFVGTEVAAAATKRGHSVTIVDMEARLLNRAVSPEISALVTAAHRRRGTAVVLNAGVSRLCGSDGTVEAVELTDGQRIPADFVVVGIGVVPNTEIAHDAGLAVDNGILVDDRLRTNDHRISAIGDCARFPCAHADGQMLRLESVQNAVDHARHVAARLMGDAGPYDAVPWFWTDQCGLKIQIAGIGAQGAESVVIGDEAAERCSVLRFRSGELSCVESVNSSGEHMAARKILRGGPRPVAPVDGSPAAFDLKHIAREVATAR

SEQ ID NO: 13234 - protein, 276 aa, Halobacterium sp. NRC-1
MTRSDLAAAFDDGPALVSYVVAGDPTPAATAEYIDALVDGGTDVIELGLPFSEPVAEGTTIQNAIKRALDAGMTPDAYLDLVARIDADVPVVCMTYYNLLFQYGDRAGPAAFVSAAAEAGVSGFVVPDLPVDESGPLREACRAHGLDLVFVVAPTTTADRRERMLDLTTGFVYVQGRVGTTGAREEVSAATPDALAALQHTDIPKAVGFGVSSGEQAREITASGADGVIVGSAYVDTVADGVADDDPPSVVADRLRDLAAELKAGAARGVPEPEHK

SEQ ID NO: 13235 - protein, 331 aa, Halobacterium sp. NRC-1
MTHTVAAVLLAGGTGTRLYPASRSHRPKQLLALGDDDRSLLRRTADRAAFADDLLAVTREAYADRVRDEVPEATVLVEPAGKDTGPALAYAASEVRARFGEDAVMLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 13236 - protein, 263 aa, Rhodobacter capsulatus
MSEPSYDHQVDRSHMQVSDEIAIQISQMNKWYGQFHVLRDINLTVHRGERIVIAGPSGSGKSTMIRCINRLEEHQSGKIIVDGIELTSDLKNIDKVRSEVGMVFQHFNLFPHLTILENLTLAPIWVRKVPKREAEETAMYYLEKVKIPEQAQKYPGQLSGGQQQRVAIARSLCMKPKIMLFDEPTSALDPEMIKEVLDTMIQLAEEGMTMLCVTHEMGFAQAVANRVIFMADGQIVEQNNPHDFFHNPQSERTKQFLSQILGH

SEQ ID NO: 13237 - protein, 365 aa, Enterobacter cloacae
MSAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 13238 - protein, 380 aa, Pichia angusta
MSTVGKTITCKAAVAWEAGKDLTIETIEVAPPKAHEVRVKIAYTGVCHTDGYTLSGNDPEGQFPVIFGHEGAGVVESVGEGVTSVKVGDHVVCLYTPECRECKFCKSGKTNLCGKIRATQGKGVMPDGTSRFTCKGKTLLHYMGCSTFSQYTVLADISVVAVDPKAPMDRTCLLGCGITTGYGAAINTAKISEGDNIGVFGAGCIGLSVIQGAVKKKAGKIIVIDVNDAKKDWAFKFGATDFVNPTKLPEGQSIVDKLIEMTDGGCDFTFDCTGNVQVMRNALEACHKGWGESIIIGVAPAGKEISTRPFQLVTGRVWRGCAFGGIKGRTQMPDLVQDYMDGEIKVDEFITHRHPLNDINQAFHDMHKGDCIRAVVTMDE

SEQ ID NO: 13239 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 13240 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNLPTPDEPGHTLGGYSQQIVVHERYVLRIRYPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 13241 - protein, 284 aa, Mesembryanthemum crystallinum
MSKEVNEEAQGLGHQHGKDYVDPPPAPLFDMGELKLWSFYRALIAEFIATLLFLYVTIATVVGNNKADTGVCGGVGLLGIAWSFGGMIFILVYCTAGISGGHINPAVTFGLFLARKVSLIRAVSYMIAQCLGAICGVGLVKAFMKGYYNSVGGGANSVAHGYSKGTALGAEIIGTFVLVYTVFSATDPKRSARDSHVPVLAPLPIGFAVFMVHLATIPITGTGINPARSFGAAVIFNSKKNWDDHWIFWVGPMVGALAAAAYHQYILRAAAIKALGSFRSNPTN

SEQ ID NO: 13242 - protein, 490 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDALYVPPIREGQGDASQYDRYPEETEQYGQQGEDVHGHLFPDF

SEQ ID NO: 13243 - protein, 192 aa, Sinorhizobium meliloti [sequence omitted]

SEQ ID NO: 13244 - protein, 1012 aa, Desulfovibrio gigas
  misc_feature (193)..(193): Xaa can be any naturally occurring amino acid
MLIKRRAFLKLTAAGATLSAFGGLGVDLAPAKAQAATMALKTVDAKQTTSVCCYCSVGCGLIVHTDKKTNRAINVEGDPDHPINEGSLCAKGASTWQLAENERRPANPLYRAPGSDQWEEKSWDWMLDTIAERVAKTREATFVTKNAKGQVVNRCDGIASVGSAAMDNEECWIYQAWLRSLGLFYIEHQARIXHSATVAALAESYGRGAMTNHWIDLKNSDVILMMGSNPAENHPISFKWVMRAKDKGATLIHVDPRYTRTSTKCDLYAPLRSGSDIAFLNGMTKYILEKELYFKDYVVNYTNASFIVGEGFAFEEGLFAGYNKETRKYDKSKWGFERDENGNPKRDETLKHPRCVFQIMKKHYERYDLDKISAICGTPKELILKVYDAYCATGKPDKAGTIMYAMGWTQHTVGVQNIRAMSINQLLLGNIGVAGGGVNALRGEANVQGSTDHGLLMHIYPGYLGTARASIPTYEEYTKKFTPVSKDPQSANWWSNFPKYSASYIKSMWPDADLNEAYGYLPKGEDGKDYSWLTLFDDMFQGKIKGFFAWGQNPACSGANSNKTREALTKLDWMVNVNIFDNETGSFWRGPDMDPKKIKTEVFFLPCAVAIEKEGSISNSGRWMQWRYVGPEPRKNAIPDGDLIVELAKRVQKLLAKTPGKLAAPVTKLKTDYWVNDHGHFDPHKIAKLINGFALKDFKVGDVEYKAGQQIATFGHLQADGSTTSGCWIYTGSYTEKGNMAARRDKTQTDMQAKIGLYPGWTWAWPVNRRIIYNRASVDLNGKPYAPEKAVVEWNAAEKKWVGDVPDGPWPPQADKEKGKRAFIMKPEGYAYLYGPGREDGPLPEYYEPMECPVIEHPFSKTLHNPTALHFATEEKAVCDPRYPFICSTYRVTEHWQTGLMTRNTPWLLEAEPQMFCEMSEELATLRGIKNGDKVILESVRGKLWAKAIITKRIKPFAIQGQQVHMVGIPWHYGWSFPKNGGDAANILTPSVGDPNTGIPETKAFMVNVTKA

SEQ ID NO: 13245 - protein, 154 aa, Oryza sativa (indica cultivar-group)
MIKEAIMALDGNGKAGSSPYAIAKYMGEQHMGVLPANYRKVLAVQLRNFAAKGRLVKVKASFKLSAAYDKKATAAKAARSKAAKGVFGGAKRKKTPRPSAAAAKKPASSAEAKKAVPPARPARAKRARKPPPRSDAGAQIHPLRHLQEGQQGSA

SEQ ID NO: 13246 - protein, 406 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRD

SEQ ID NO: 13247 - protein, 475 aa, Shigella boydii
MLYFVNRYNMIKPIILAGGNGTRLWPLSRSQFPKQFLPLLDNKYSLFQQTLQRINCLQKLSPLIICNETHRFLVSQQLKDIDCNDANVLLEPIGKNTAPAIALAAFQYLKDSEDPLLLVLAADHYISDTGIFLESIKKAKKVAEQGNLITFGIVPDYPHTGYGYIERAKEVYDTVYEIRSFKEKPPYDRACEYIETGDYYWNSGMFMFRASVFLNELKKYEPSIYENCKHAIDSATVDSTFIRPEFHSFNKSPNISIDYAVMERTSIGMVISLDAGWSDVGSWSALCDINSKYHSSDNNNNNNVISIDSSNNFILSEDNLVATVGIKDLIIINTKDALLVADKNNDQNVKLVVEQIKKLGRNEHVEHPVNYRKWGRFEQIDEGVGFQVNRITIDVGKYISKQYHKYRAEHWIIVSGIAEITLDKVTKIYKENESVYVPTNCIHSIKNLGNTILEIIEVQSGTYFGEDDIIRLSTE

SEQ ID NO: 13248 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 13249 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVNHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 13250 - protein, 442 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQ

SEQ ID NO: 13251 - protein, 439 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPVGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPAN

SEQ ID NO: 13252 - protein, 106 aa, Streptococcus mutans
MSRKPIIAGNWKMNKTAAEAREFIDAVKNNIPSNNLVDTVIGSPALFLEGMKKGVKDTELQVAAQNCYWEDFGAFTGETSPAALAALGVDYVIIGHSERRDYFHET

SEQ ID NO: 13253 - protein, 415 aa, Neurospora crassa
MSFANMLNRLHGQPESYDKKSKYSFGRTLGAGTYGIVREASGPTGRVAVKIILKKNVKGNEQMVLDELEMLQRLKHPHIVKFVDWFESRDKYYIVTQLATGGELFDRICEQGKFTEKDASQTIKQVLGAVNYLHENNVVHRDLKPENLLYLTRDADSDLVLADFGIAKMLDNKDEVLTTMAGSFGYAAPEVMLKQGHGKPVDMWSMGVITYTLLCGYSPFRSENLQDLIDECSSGSVVFHERYWKDVSNDAKDFILRLLQPKPENRWTSQVRLTLAHPWLRGDSATNHNLLPEIKAYLTKARLRRGIEMVKLANRIEALKMQEDDPENTDMPGDATLAADQAQSRHRALSLASTKGGSSDAENATAPAEKRTLSKTIKTAIFREVVLAKVREMKEAEEANKLKEEAETKAKSFQA

SEQ ID NO: 13254 - protein, 291 aa, Arabidopsis thaliana
MCFSPEDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDLVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADRNEDITELNSVTFNVCLDKVKSLGIIEFTPTETSLRDTVLSLKEKCLV

SEQ ID NO: 13255 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMHDLYNMINTVKSDCPDSTLLGTFVENHDNPRFASYTNDIALAKNVAAFIILNDGIPIIYAGQEQHYAGGNDPANREATWASGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 13256 - protein, 186 aa, Arabidopsis thaliana
MASYQNRPGGQATDEYGNPIQQQYDEYGNPMGGGGYGTGGGGGATGGQGYGTGGQGYGSGGQGYGTGGQGYGTGTGTEGFGTGGGARHHGQEQLHKESGGGLGGMLHRSGSGSSSSSEDDGQGGRRKKGITQKIKEKLPGHHDQCGQAQAMGGMGSGYDAGGYGGEHHEKKGMMDKIKEKLPGGGR

SEQ ID NO: 13257 - protein, 1938 aa, Bacillus sp.
MKKRFQRGMAGLLSILLIVSMFAGYLPARAAAETGDKRIEFSYERPDGNYEGWNLWVWGTGVKDDQIDFTEFKEGKAYADIAVSDNADKVGFIIRKGDWEEKDFDGDRSITINKIDNITKVHVTSQQEKFGQIPDGSPPVVADGNADFFFRDKELYAAGEMDKVEKVELSILGEKYEMNGEPEKERFTYTLSDLPTGEHEYTYLVTVDGQTEEVTDPYNTVDGRSVVEYVTSDVQVSASFIPAKVDYNQNAVVKVDIESETETKIREMSINLSEIGGKEKATIDPALNELTVAVKQGVTAGVKNLPITAIDEFGNRHEGSATLEVQARTITGEKADFDWDQSVVYFMLTDRFFDGDSSNNDPHGIGYDTSKSGTYQGGDFKGITQRLDYLDELGINTIWISPVVDNIKFDVRHSEGPDTPYYAYHGYWADNFGELNPHFGSMADFHEMIDAAHERGIKIMVDVVLNHTGYGLKPGDSSSVANFPTDEDRARFDGMLRDGGSGEVRGELAGLPDFLTENPDVREQVVQWQTDWIEKSRTAKGNTIDYFRVDTVKHVEDTTWMAFKNALTKAMPEHKLIGEAWGANVNDDLGYLNSGMMDSLLDFDFKNYARDFANGQLDAVQQKLEARNSKLNNTATLGQFLGSHDEDRFYEVVEGDLGKYQVAASLQLTAKGQPVIYYGEELGLPGKNDYPYYTNRQNMPWDDVDGNEILEHYQKLLAFRNDNPNTFAKGDRKKVAGSDSEGYLLFSRTYGENSVYVGLNTEAAAKDVTLNFGSSEAVVTDRYSGQEYQANEEGQVTFSIPAMEDGGTVLLEVENGAVPPVEEEPTEPGEIEENTLRIHYQRTDNSYENLGLWLWGDVAAPSENWPSGGTPFQAGNVTDYGAYVDVELAEDAQNIGFLVLNTTNGDKDGGDKAVELFSPDLNEIWIKQGSDEVFLYEPVDLPANTVRIHYERTNADYEGWGLWNWEDVESPSDGWPNGAADAAGIGKYGAYYDIKLKEDANKIGFLFVNKQSGGQTGDMTFDMLKQYNQLFVKEGEDKVYTNPYGTVPLALVSGEVLSDKLISLTFTRTEGLDLEELKEQLEIKDVDGNDVSFTDVTIEGEKTVHVHGEFDLEKIPFSVTYLDRTISVKSGWKLIDEMYAYDGKLGAELHEDGTATLKVWSPKADNVSVVLYDKVDQNEVVDTIEMVKGDRGVWSVKLTKDNTGLDSLKGYYYHYEITHGDVTNLALDPYAKSMAAWNNEAGDKVGKAAIVDIGSIGPELDYADIPGFEKREDTIIYEVHVRDFTSDPNIGEDLKAQFGTFASFVEKLDYIQELGVTHIQLLPVMSYYFSNEFESGERMLEYASTGTNYNWGYDPHNYFSLSGMYSENPEDPELRIKEFKNLINEIHKRDMGVVLDVVFNHTAQVHIFEDLVPNYYHFMDADGTPRTSFGGGRLGTTHEMSRRVLVDSIKHWVDEYKVDGFRFDMMGDHDAESIQIAFDEAKKLNPNIVMIGEGWVTFAGDEGEPVQAADQQWMQYTEAVGSFSDEFRNELKSGFGSEGQPRFITGGAVNVQQIFDNIKAQPHNFMADQPGDVVQYIEAHDNLTLYDVIAQSIKKDPEIAENDLEIHKRIRVGNAMVLTSQGTAFLHAGQEFGRTKQWRAPATEAPYKSTYMTDADGNPFVYPYFIHDSYDSSDIINRFDWEKATDAEKYPVNNVTRDYTAGLIELRRSSDAFRLGSRELVDSNVTMVDAPEIKEQDLVVAYRSVSTAGVEYYTFVNADTSSRTLTLGQDLTEGVVVVDAEEANVAGVAEPAGFELTAEGITLEPLTTVVVRVGEQEGTDPGDGDGDGNTPPPGDGDGDGNTPPPGDGDGDGNTPPPGNGNGNNPGTPPGKGGENPGKGKNDKTPPGKGGDNPGKGNKLPLTATGTLNYILFGAIMLVLGTLLYLGVRRKAGLKEKTL

SEQ ID NO: 13258 - protein, 509 aa, Centaurea calcitrapa
MGTAIKASLLALFLFVLLSPTAFSASNGGLLRVGLKKRKVDQINQLRNHGASMEGKARKDFGFGGSLRDSDSDIIELKNYMDAQYYGEIGIGSPAQKFTVIFDTGSSNLWVPSAKCYFSVACLFHSKYKSSHSSTYKKNGTSAAIQYGTGSISGFVSQDSVKLGDLVVKEQDFIEATKEPGVTFLAAKFDGILGLGFQEISVGKSVPVWYNMVNQGLVQEPVFSFWFNRNADEEEGGELVFGGVDPNHFKGKHTYVPVTQKGYWQFNMGDVLIEDKTTGFCADGCAAIADSGTSLLAGPTAIITQINHAIGAKGVMSQQCKTLVDQYGKTIIEMLLSEAQPDKICSQMKLCTFDGARDVSSIIESVVDKNNGKSSGGVHDEMCTFCEMAVVWMQNQIKRNQTEDNIINYVNELCDRLPSPMGESAVDCNDLSSMPNIAFTIGGKVFELCPEQYILKIGEGEAAQCISGFTAMDVAPPRGPLWILGDVFMGQYHTVFDYGKLRVGFAEAA

SEQ ID NO: 13259 - protein, 443 aa, Pseudomonas putida
MNTDLKQRLDNDPMGRFQYLAIGICIVLNMIDGFDVLVMAFTASSVSAEWTLNGAQVGLLLSAGLFGMAAGSLFLAPWADRFGRRPLILLCLALSGIGMLLSAMSQSPLQLALLRGLTGLGIGGILASSNVIASEYASKRWRGLAVSLQSTGYALGATLGGLLAVWLLGHWGWRSVFLFGGIVTVLVIPLVLLWLPESLDFLLARRPANALARVNRLAARLGQPALAQLPTAMAREQGAARGFRQLLTPAMRRTTLVIWLLFFLVMFGFYFVMSWTPKLLVAAGLSAQQGITGGVLLSVGGILGAALIGGLASRWPLTRVLALFMLITAVLLVLFVVNGASVSAALALGLLIGLFSNGCVAGLYALSPVVYDASVRATGVGWGIGIGRMGAILSPTVAGMLLDGGWQPLHLYGVFASVFVLAAGCLLLLRPAASTARPVLADA

SEQ ID NO: 13260 - protein, 422 aa, Schizosaccharomyces pombe
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 13261 - protein, 364 aa, Cochliobolus carbonum
MVAYALTSMLLSAGALVAAAPSGLDARDGCTFTDAATAIKNKASCSNIVISGMTVPAGTTLDLTGLKSGATVTFQGTTTFGYKEWEGPLISVSGTNIKVVGASGHTIDAAGQKWWDGKGSNGGKTKPKFFYAHSLTTSSISGLNIKNTPVQAFSINGVTGLTLDRITIDNSAGDSAGAHNTDAFDIGSSSGITISNANIKNQDDCVAINSGSDIHVTNCQCSGGHGVSIGSVGGRKDNTVKGVVVSGTTIANSDNGVRIKTISGATGSVSDITYENITLKNIAKYGIVIEQDYLNGGPTGKPTTGVPITGVTLKNVAGSVTGSGTEIYVLCGKGSCSGWNWSGVSITGGKKSSSCLNVPSGASC

SEQ ID NO: 13262 - protein, 475 aa, Chlorella-like algae
MAPQTETRAGAGFKAGVKDYRLTYYTPDYQPKDTDILAAFRMTPQPGVPPEEAGAAVAAESSTGTWTTVWTDGLTSLDRYKGRCYDIEPVPGEENQYIAYIAYPLDLFEEGSVTNLFTSIVGNVFGFKALRALRLEDLRIPPAYVKTFQGPPHGIQVERDKLNKYGRGLLGCTIKPKLGLSAKNYGRAVYECLRGGLDFTKDDENVNSQPFMRWRDRFLFVAEAIYKSQSETGEIKGHYLNATAATAEEMLKRAECAKDLGVPIVMHDYLTGGFTANTSLAHYCRDNGLLLHIHRAMHAVIDRQRNHGIHFRVLAKALRLSGGDHLHSGTVVGKLEGEREVTLGFVDLMRDDYIEKDRSRGIYFTQDWVSLPGTMPVASGGIHVWHMPALVEIFGDDACLQFGGGTLGHPWGNAPGAAANRVALEACTQARNEGRDLAREGGDIIRAACKWSPELAAACEVWKEIKFEFETIDTL

SEQ ID NO: 13263 - protein, 365 aa, Mesembryanthemum crystallinum
MAAAVTAAVSFPSTKSTPLSTRTSSVITHEKINFNKVPLYYRNVSVGGKVGTIRAVASDVEAPVAKVEKHSKKMEEGVIVNKYKPKNPYTGRCLLNTKITGDDAPGETWHMVFSHEGEIPYREGQSVGVIPEGIDKNGKPHKLRLYSIASRPLGDFGDSKTVSLCVKRLIYTNDNGEIVKGVCSNFLCDLKPGSEVVLTGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDRELWELLKKDNTYVYMCGLKGMEKGIDDIMVSLAAEDGIDWFDYKKQLKKAEQWNVEVY

SEQ ID NO: 13264 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 13265 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 13266 - protein, 475 aa, Circaea alpina
  misc_feature (28)..(29): Xaa can be any naturally occurring amino acid
  misc_feature (244)..(244): Xaa can be any naturally occurring amino acid
MSPQTETKAGVGFKAGVKDYKLTYYTPXXETKDTDILAAFRVSPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATXGTCEEMMKRAAFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFQAMDTL

SEQ ID NO: 13267 - protein, 475 aa, Clarkia xantiana
  misc_feature (235)..(235): Xaa can be any naturally occurring amino acid
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYICYVAYPLDLFEEGSVTNMFTSIEGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEXKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFQAMDTL

SEQ ID NO: 13268 - protein, 186 aa, Azotobacter vinelandii
MIPVILSGGSGSRLWPLSRKQYPKQFLALTSERTLFQQTLQRLNFEGMQSPIVVCNQEHRFIVKEQLEAIGLNIQGLLLEPFGRNTAPAIALTAMKLLAEGRDELLLILPADHVIADQQAFQQALKVAAQAAEMGELVLFGIPAHSPETGYGYIKCDLAVQGTLPEGSNRVLQFVEKPDLAAPANS

SEQ ID NO: 13269 - protein, 390 aa, Mycoplasma pneumoniae M129
MAAGKRDYYEVLGVSRSATAQDIKRAFRKLAMQYHPDRHKGEGETVQKQNEEKFKEVNEAYEVLSDTEKRGMYDRFGHEGLNASGFHETGFNPFDIFNSVFGEGFSFDMDGGSPFDFIFSRGKKSRQNRVVLPYDLEIAVGVDISFFEMTNGCTRTIEYTKRVTCSACDGFGAEGGETGMVSCNSCEGNGFILKNQRSIFGTVQSQMLCQSCGGQGKQAKHKCKTCKGSKYKKVPTTKEIQIPAGIYHGDALVDDHGGNEFGGHVGKLVVHVGVLPSKIFKRVDHNVVANVLVDPMIAITGGKIELPTLEGIKEFNLRAGTKSGEQIVIPGGGIKFTKNFRKKAGDLIIIISYARPSEYSAPELRKLKEFIKPNQEVKQYLNALKNEYKS

SEQ ID NO: 13270 - protein, 175 aa, Mycoplasma pneumoniae M129
MGIKSIIIDQKQVEAGCNAALKWCNEHFAGKQVIVLGILKGCIPFLGKLISQFTFDLQLDFVAVASYHGGSRQQEAPKIVLDMSHDPKGKDILLIEDIVDSGRSIKLVLDLLHTRKAKSVILVSFIEKLKPREADIKVDYSCFKNQDEFLVGFGLDYQGFYRNLPYVGVFDPEDN

SEQ ID NO: 13271 - protein, 394 aa, Mycoplasma pneumoniae M129
MAREKFDRSKPHVNVGTIGHIDHGKTTLTAAICTVLAKEGKSAATRYDQIDKAPEEKARGITINSAHVEYSSDKRHYAHVDCPGHADYIKNMITGAAQMDGAILVVSATDSVMPQTREHILLARQVGVPRMVVFLNKCDIATDEEVQELVAEEVRDLLTSYGFDGKNTPIIYGSALKALEGDPKWEAKIHDLMNAVDEWIPTPEREVDKPFLLAIEDTMTITGRGTVVTGRVERGELKVGQEIEIVGLRPIRKAVVTGIEMFKKELDSAMAGDNAGVLLRGVDRKEVERGQVLAKPGSIKPHKKFKAEIYALKKEEGGRHTGFLNGYRPQFYFRTTDVTGSISLPENTEMVLPGDNTSITVELIAPIACEKGSKFSIREGGRTVGAGSVTEVLE

SEQ ID NO: 13272 - protein, 244 aa, Mycoplasma pneumoniae M129
MRTKYLIGNWKTNKDLHQALAFVEQFKQHPAKTKAVLGIAPVHVHLTEVNKVLPNNLLLLAQDANFIASGSYTGTVSYTQLQDIKVNSVIIGHSERRKYFNETAQVINQKLKACLQAGMLVVLCIGETEGQPISFLKEDLTQVLQGIDLSLLKQLVIAYEPIWAIGTGKTATPEIANNTIAQIRVYLSELYNKEIAQQTSILYGGSVAKDNIKELAQTEQIDGFLVGKASLDVNDFLVMAQVYA

SEQ ID NO: 13273 - protein, 508 aa, Mycoplasma pneumoniae M129
MHKKVLLAILDGYGISNKQHGNAVYHAKTPALDSLIKDYPCVMLEASGEAVGLPQGQIGNSEVGHLNIGAGRIVYTGLSLINQNIKTGAFHHNQVLLEAIARAKANNAKLHLIGLFSHGGVHSHMDHLYALIKLAAPQVKMVLHLFGDGRDVAPCTMKSDLEAFMVFLKDYHNVIIGTLGGRYYGMDRDQRWDREEIAYNAILGNSKASFTDPVAYVQSAYDQKVTDEFLYPAVNGNVDKEQFALKDHDSVIFFNFRPDRARQMSHMLFQTDYYDYTPKAGRKYNLFFVTMMNYEGIKPSAVVFPPETIPNTFGEVIAHNKLKQLRIAETEKYAHVTFFFDGGVEVDLPNETKCMVPSLKVATYDLAPEMACKGITDQLLNQINQFDLTVLNFANPDMVGHTGNYAACVQGLEALDVQIQRIIDFCKANHITLFLTADHGNAEEMIDSNNNPVTKHTVNKVPFVCTDTNIDLQQDSASLANIAPTILAYLGLKQPAEMTANSLLISKK

SEQ ID NO: 13274 - protein, 456 aa, Mycoplasma pneumoniae M129 [sequence omitted]

SEQ ID NO: 13275 - protein, 409 aa, Mycoplasma pneumoniae M129
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 13276 - protein, 457 aa, Mycoplasma pneumoniae M129
MNYDLIIIGAGPAGYVAAEYAGKHKLKTLVVEKEYFGGVCLNVGCIPTKTLLKRAKIVDYLRHAQDYGISINGQVALNWNQLLEQKGKVVSKLVGGVKAIIASAKAETVMGEAKVLDPNTVEVAGKTYTTKSIVVATGSRPRYLTLPGFAEARQNGFVIDSTQALSLEGVPRKLVVVGGGVIGIEFAFLYASLGSEVTILQGVDRILEIFDTEVSDLVAKLLQTKNVKIITNAQVTRANNNEVFYSQNGQEGSVVGDRILVSIGRIPNTECLDGLNLQRDERNRIVLNQDLQTSIPNIYIVGDANAQLMLAHFAYQQGRYAVNHILNKKQVKPAQKLTCPSCIYTNPEVASVGYTEMELKKQGIPYVKTNLVLAHCGKAIADNETNGFVKMMFDPQTGKILGCCIIAATASDMIAELALAMGAGLTVFDIANSISPHPTINEMIADVCKKALFDHFK

SEQ ID NO: 13277 - protein, 508 aa, Mycoplasma pneumoniae M129
MIHHLKRTKIIATCGPALTKKLWTLAMLDDPAYAAMKAEAYANIENIIKNGVTVIRLNFSHGNHEEQAVRIKIVRDVAKKLNLPVSIMLDTNGPEIRVFETAPEGLKILKDSEVVINTTTKEVAKNNQFSVSDASGTYNMVNDVKVGQKILVDDGKLSLVVKRIDTKNNQVICVAQNDHTIFTKKRLNLPNADYSIPFLSAKDLRDIDFGLTHQIDYIAASFVNTTENIKQLRDYLASKNAKHVKLIAKIESNHALNNIDGIIKASDGIMVARGDLGLEIPYYKVPYWQRYMIKACRFFNKRVITATQMLDSLEKNIQPTRAEVTDVYFAVDRGNDATMLSGETANGAFPLNAVYVMKMIDKQSETFFDYQYNLNYYMANSKARHSEFWKQVVLPLAQKTAPKRKLINSDFKYDFVVHATNNLNEIYALSNARLAAAVIILTNDPQVYTGHGVDYGIFPYLIDQKPQSLSKAEFKSLANVAIKHYQQHGEISQLKQCLGVFHNKIISL

SEQ ID NO: 13278 - protein, 215 aa, Mycoplasma pneumoniae M129
MLNLVVNREIAFSLLPLLHQFDRKLLEQFFADGLRLIHYDVMDHFVDNTVFQGEHLDELQQIGFQVNVHLMVQALEQILPVYLHHQAVKRISFHVEPFDIPTIKHFIAQIKQAGKQVGLAFKFTTPLVNYERLVQQLDFVTLMSVPPGKGGQAFNSAVFNNLKQAHKYHCSIEIDGGIKLDNIHQIQDDVNFIVMGSGFIKLERWQRQQLLKTNQ

SEQ ID NO: 13279 - protein, 430 aa, Mycoplasma pneumoniae M129
MESKWLTVDTKHLYGFDEAIFIQKYQKKVNQIHQQFLNQQLPDGHMNGWYSQPDQDHKGLLKQINTIAKQFNALKVTDIVYLGIGGSYTGIRAILDFLKPEQKANIKVHFVPDISAFNIAAVARAIKGKSWALVVTSKSGRTLEPAVTFRYFRNLLHKQYKQKHALRTVVITDAVKGLLVGMSNQYGYAHLTIPSNIGGRFSTLSPAGLLLAKLCGHDPKQLLLGTLTAKQELANSDLNTNSAYYYAALRHWLYTTKKLKIEVTVAYHSAYEYLLLQHRQLFGESEGKGGKSLFPTFSLFTTDLHSMGQLYQEGEKNFFETVIQVQTQFHDLELPPSDFNNDDQLDYLLAKSMNEISNTALEAVVEAHFQSNVNIIKLTLKERTTFMFGYFYFWLSMATMMSGSLLGHNVFDQPGVEVYKQLMFAKLGRE

SEQ ID NO: 13280 - protein, 117 aa, Craterostigma plantagineum
MAHSLGEQYDLGKPTEEHHESHPPAHQAPHAGGELGAGQKTSQLARSNSSSSSSSEDDGQGGRRKKPIKEKVKEKLPGGAGGKQTGECGTTTTTAAGGHEEKKGVMEKIKEKLPGQH

SEQ ID NO: 13281 - protein, 167 aa, Pisum sativum
MLVYQDLLTGDELLSDSYPYKEIENGMLWEVEGKWVVKGAVDVNIGANPSAEGGEDEGVDDTAVKVVDIVDVFRLQEQPPFDKKQFLGFVKKYIKLLTPKLEAEKQEHFKKNIEGATKYLLGKLKDLQFFVGESMHDDGSLVFAYYKDGAADPTFLYFSFALKEIKC

SEQ ID NO: 13282 - protein, 381 aa, Oryza sativa (indica cultivar-group)
MASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 13283 - protein, 413 aa, Cucumis sativus
GDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 13284 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVAGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 13285 - protein, 282 aa, Escherichia coli
MKPENKLPVLDLISAEMKTVVNTLQPDLPPWPATGTIAEQRQYYTLERRFWNAGAPEMATRAYMVPTKYGQVETRLFCPQPDSPATLFYLHGGGFILGNLDTHDRIMRLLASYSQCTVIGIDYTLSPEARFPQAIEEIVAACCYFHQQAEDYQINMSRIGFAGDSAGAMLALASALWLRDKQIDCGKVAGVLLWYGLYGLRDSVTRRLLGGVWDGLTQQDLQMYEEAYLSNDADRESPYYCLFNNDLTREVPPCFIAGAEFDPLLDDSRLLYQTVSCASAAL

SEQ ID NO: 13286 - protein, 230 aa, Lotus corniculatus
MTVAGYLNIGDFIPPLEWLDLQGVQGKMKKLHNRFDAFFAHIIEEQKVILKSEKHQDLLSTLLSLKEAPEDGDKLNDTEIKALLLNLFTAGTDTSSSTAEWAIAELIKNPRIMGQVQQELDNVVGKDKLVTELDMPNLPYLEAVVKETFRLHPSTPLSLPRAAAKSCEVFDYHIPKGATLLVNVWAISRDPKEWASPLEFRPERFLPGGEKASVDVRGTDFALIPFGAGR

SEQ ID NO: 13287 - protein, 447 aa, Listeria innocua Clip11262
MMKDMTTGNPTKLIFLFAMPMLIGNLFQQFYTMIDAVIVGKFVSVDALAAVGATNSVNFFMISLIIGLMSGISVVVAQYFGFKDYDRLKDVIATATYAVVFSAVILTIAGVLLAKPLLILLRTPANILDDSTIFLTTLFIGILPMSLYNGMAAILRALGNSITPLIFLILSSLMNIALDFLFVVYMGMGVRGAAIATVLSQTAAAIAVIYYAYRHVSFMRIERAKFKLSTPLLKEMVRIGLPSGLQGSFISIGNMALQSLINGFGSSVVAAYTAASRIDSLTYQPGIAFGAASSMFAGQNIGAGKIDRVREGFWSGIKVVTAISIGITILVQLFARQFLLLFVDSSETEVINIGVSYLLIVSLFYVVVGILFVVRETLRGTGDAMVPLAMGIFELVSRLAIGFILSLYIGYVGLWWATPVAWITATMLGVWRYKSGAWQKKAVIRRK

SEQ ID NO: 13288 - protein, 477 aa, Listeria innocua Clip11262
MTESKFPKGFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEANPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSINDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 13289 - protein, 502 aa, Listeria innocua Clip11262
MAFYFEEPSRTFSEFLLVPGYSSAECVPTNVSLKTPIVKFKKGEESAITMNIPLVSAIMQAVSDDNMGIALAKEGGVSFVFGSQSIESEAAMVSRVKNHKAGFVISDSNISPDKTLQDILDLKEKTGHSTVAVTEDGTAHGKLLGIVTSRDYRVTRMSPDEKVADFMTPFEKLVTAKKSTTLKEANNIIWDHKLNALPLVDDNEHLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 13290 - protein, 308 aa, Listeria innocua Clip11262
MTIVNSITDLIGKTPIVKLNRLPEAGSADVYVKLEFQNPGGSVKDRIANAMIESAEKSGALKPGDTIIEPTSGNTGIGLAMVAAAKGYQAIFVMPETMSIERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 13291 - protein, 457 aa, Listeria innocua Clip11262
MAKAKRTTKFVCQSCGYESAKWMGKCPNCNEWNQMVEALEPSKKSRSAFNHTGEPSKATPITQIASEEEARVETNMPELNRVLGGGVVPGSMVLVGGDPGIGKSTLLLQVSAQLTLTNKKVLYISGEESIKQTKLRAERLQVSGDNLYVYAETNLEAVQETIDFVKPDFVVIDSIQTVYHPDVTSAAGSVSQVRECTAALMRIAKMQNIAIFIVGHVTKEGAIAGPRLLEHMVDTVLYFEGERHHAYRILRAVKNRFGSTNEMGIFEMRDIGLVEVANPSEVFLEERLEGASGSTVVASMEGTRPVLVEIQALVSPTMFGNAKRMATGIDYNKVSLIMAVLEKRVGLMLQNQDAYLKAAGGVKLDEPAVDLAVAVSVASSYRDKPTRSTDCFIGELGLTGEIRRVARIEQRVQEAAKLGFKRIFIPKNNEGTWKVPKDVQVVGVETIGEALKKALPD

SEQ ID NO: 13292 - protein, 486 aa, Listeria innocua Clip11262
MTEVKKQFPKGFLWGGATAANQVEGAYDVDGKGLSTADMVKFIPKEERTKDHALDVSKAEIEAIIAGKVEGRFPKREGVDFYHRYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSYMNRFFQENDINIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLMGYTSWGPIDLVSASTSEMSKRYGFIYVDQDDWGKGTLERSRKDSFFWYKKVIETNGEDLD

SEQ ID NO: 13293 - protein, 478 aa, Listeria innocua Clip11262
MEHQKRSPFPKDFLWGSASAAYQIEGAWDADGKGKSVWDEYVRIPGTTFKGTNGDVAVDHYHRYKEDVKLMAEAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 13294 - protein, 393 aa, Listeria innocua Clip11262
MKISKRLQNLPDQFFSSLVEKVGKKVAEGHDVINLGQGNPDQPTPKHIVEAMKTASENPMNHKYSLFRGKQELKQAVADFYAREYNVTIDPNTEVAILFGTKTGLVELPMCLMDPGDVMLLPDPGYPDYLSGAVLGEVQFETMPLIAENDFLPDFNKIPEEIAKKAELMYLNYPNNPTGAVATTHFFEETVAFAKENNITIAHDFAYGGIGFDGKKPISFLETPGAKEVGIELYTLSKTYNMAGWRVGFAVGNKDVVEAINLIQDHMYVSLFPGIQDAAIEALTGDQTCVQELNARYESRRNAFIAACDKIGWEAIAPAGSFFAWMPVPKEFTSSEFADYLLNEVSVAVADGSGFGTFGEGYVRVGLLMDEKRLEEAVARISKLHLFDKVAQN

SEQ ID NO: 13295 - protein, 463 aa, Listeria innocua Clip11262
MNNNFLWGGATASYQCEGAWNVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKTFKEGGYPGQIGIVHSYTPVNGVDESIETKIAMRYADNYCNNWILETAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 13296 - protein, 471 aa, Listeria innocua Clip11262
MHTNTGFPADFLWGGAAAANQFEGAYNVDGKGLSVQDVTPKGGFGQITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGAYPGYMKRYFRENNIELDVTEEDLEILKNTVDFISFSYYMSTTETADESKRKAGAGNILGGVQNPYLEASEWGWQIDPKGLRVVLNEFWDRYQKPLFIVENGLGAIDQLEQDENGNYTVNDDYRINYLSAHLSQVKEAIKDGVELMGYTSWGCIDLVSASTAEMKKRYGFIYVDRNNDGTGTLNRYKKKSFDWYKNVIATNGEDL

SEQ ID NO: 13297 - protein, 254 aa, Listeria innocua Clip11262
MRKPLVGINMKNYINTRAQTSEWLEATIPLLENFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVHANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 13298 - protein, 480 aa, Listeria innocua Clip11262
MKELLTFPKDFWWGSAWSAEQAEGRGDTGKAKTVWEHWFETEPNRFYEGVGSEITTDHFNRYKEDVQWMKKTGHNSFRISISWARMFPNDGVGEVNQKAIAFYRDLLTEMNENGIKPFANLYHFDMPVALQDAWGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 13299 - protein, 488 aa, Listeria innocua Clip11262
MADVRKLKNYINGEWVESKADKYEDVINPATGEVLCQVPISTRAELDQAAVIAEQAFEKWSQVAVPRRARVLFSFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENETIKAVSFVGSKPVGEYVYKTGSANLKRVQALTGAKNHTIVLNDADLEDTVTNVISAAFGSAGERCMACAVVTVEEGIADDFLAALRTAAQNVKIGNGLDDGVFLGPVIREENQKRTIAYIEKGVEEGAKLTVDGRETGLSEGYFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 13300 - protein, 325 aa, Listeria innocua Clip11262
MNLNKHSERKFDLITVGRACIDLNAVEYNRPMEETMTFSKYVGGSPANIAIGTAKLGLKVGFIGKISDDQHGRFIEKYMRDLNINTDGMVKDTAGRKVGLAFTEIKSPEECSILMYRENVADLYLTPEEISEDYIKETRVLLVSGTALAQSPSREAVLKAVHLAQKNDVIVAFELDYRPYTWKNTEETAVYYSLVAEQADVIIGTRDEFDMMENQIGGNNEMTIDNLFKHKAEIIVIKHGVEGSFAYTKAGETFRAQAYKTKVLKTFGAGDSYASAFLYGLFSGENIETALKFGSAAASIVVSKHSSSDAMPTADEIKALIANAD

SEQ ID NO: 13301 - protein, 222 aa, Listeria innocua Clip11262
MKMIAASIMCADSLHLADELRALEQANVKMLHCDVMDGVFVKNAAMGAYVLQDIKNNTDMLLDIHLATVNPDKFVDLYAAIKPAYMSFHVEASPDVDATINHIRELGIKPSIAISPDTEIEQIYPFLEKVDMVLMMTVNPGFAGQKFQHHVLEKIKKLQKELESHTNKPLIEVDGNIFEETVRLLEPIGADVYVVGTAALFNDKAGSYTEKLAPLREIIQER

SEQ ID NO: 13302 - protein, 216 aa, Listeria innocua Clip11262
MAKIVPSVFGADIGRINEQLEVLEKNGIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNDELAKECTLAGADLIVVGSYLFEGDIEANLEKLSKGVLTE

SEQ ID NO: 13303 - protein, 348 aa, Listeria innocua Clip11262
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 13304 - protein, 105 aa, Listeria innocua Clip11262
MNTVDFSKGLVPTIILDDQNGEVLMLAYMNQESYQKTLETGYTWFFSRSRNELWNKGETSGNTQKVKQIWTDCDNDTLLIRVIQTGPACHTGKKSCFFNLIKEDF

SEQ ID NO: 13305 - protein, 431 aa, Listeria innocua Clip11262
MDKLFKLRENKTTVRTEILAGLTTFLSMAYVLFVNPSMLATTGMELKAVFVATILASVVGSLAMGLIANYPIGLAPGMGLNAFFAYTVCAQWGIPWQTALAGVLVSGLVFICLTLSGLREKIVNAIPTELKFAVGAGIGFFIAFLGLKNAGIIVPNDSTIVALGDLHSGPVLLAVFGIIITVAYMTIGWKGAIFFGMATTAIAGMLFGLIDVPTQVVSSVPSMESTFGQAIIHLPDIFTPQMLIVILTFFFIDFFDTAGTLVAVATQAGFVKDNKIPRAGRSLFSDSLATVFGAIFGTSTTTSYVESTAGVAVGGRTGLTAVVIAICFSLSLFFSPLLGVITSAVTTPALVIVGILMIGNVAHIDWTKFEVAVPSFFVILMMVLTFSIATGIAIGFIFYPITMVLKGRYKEVHPIMYVMMVLFILYFMFVV

SEQ ID NO: 13306 - protein, 464 aa, Listeria innocua Clip11262
MTYKFPDNFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANNVEPFMNLYHFDMPMSMQEKGGFESREVVDAYATFAKTCFELFGDRVKHWFTFNEPIVPVEAGYLYDMHYPNVVDFKRATQVGYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNDFKRTVKASGHWYKELSENNGFED

SEQ ID NO: 13307 - protein, 305 aa, Listeria innocua Clip11262
MKRITIGNSDLTASEISLGCMRMADLSKEEANKVINTALENGIDFFDHADIYGGGKSEEVFADAIDMNATVREKMILQSKCGIRQGFFDFSKEHIISSVEGSLKRLKTDYLDTLLLHRPDTLFEPEEVAAAFTELEKSGKVRHFGVSNQNPGQIELLKKYVDQELIANQLQFSIMHTGMIDTGFNVNMTIDPSLDRDGGILEYSRLHNMTIQAWSPFQYGFFEGVFLDNDKFPELNKTIDKIAAYKGVTNSAIAVAWIQRHPASFQTVVGTMNPGRIADIAKASDVTLSREEWYEIYSAAGNQLP

SEQ ID NO: 13308 - protein, 463 aa, Listeria innocua Clip11262
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAVSGPFNPEVGTFINLPAIIIVLVIAFLLTLGIKESTRVNTIMVAIKVGVILLFLVVGVFYVKPDNWQPFMPFGISGVMNGAALVFFAYLGFDAVSSAAEEVKNPQRTMPIGIIGSLLICTILYVAVSAVLTGMVPYTDLNVTDPVAYALQVINQDWVAGIVSLGAVVGMITVILVMSYGATRLIFAMGRDGLLPKVLAEINQKYQTPVKNTWIFAFIVAIISGLVPLDRLAELVNIGTLLAFMMVSIGIIFLRKNKSIQQSGFKVPFYPVLPIISFLLCAFLISRLSVHTWILCGIWFVIGLIVYFAYGRKNSELLKK

SEQ ID NO: 13309 - protein, 458 aa, Listeria innocua Clip11262
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALGCVLILLLFNLATVKAFGEIEFWFAIIKVVVIIALIVIGFVLVFIGYKHGTSTASFSNLIDYGGFFPNGVAGFLLAFQMATFSFVGIELVGVTAGEADDPERTLPKAINNIPIRILIFYIGALLVLMSIYPWSNIDPDTSPFVSVFTMIGIPAAAGIINFVVLTAAMSSCNSGIFSTSRMLYTLSAEGKAPKKMHHLSSNGVPATALITSTACLLIGVFLNYILPEQVFILVTSIATICFIWVWGIILVAHLRFRHKHPEISAKSKFKMPLSPFMNWVSLIFFAGLLIILGFAADTRIALFVTPVWFLILAIAYQILKASNRKTKIRHN

SEQ ID NO: 13310 - protein, 486 aa, Listeria innocua Clip11262
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 13311 - protein, 242 aa, Listeria innocua Clip11262
MTKLKVTGLKKSFGANEVLKGIDIEVKEGEVVCVIGPSGSGKSTFLRCMNNLEEITAGEVVVDDFNITDKKVDINKVRENIGMVFQHFNLFPHLSVLENITLAPVELKKMDKEAAKSNALRLLEQVGLKEKADEFPNQLSGGQKQRVAIARALAMDPDIMLFDEPTSALDPEMVGEVLGVMKELAKDGMTMMIVTHEMGFAREVGDRVIFMDGGYIVEEGKPADIFDNPTNERTISFLDKVL

SEQ ID NO: 13312 - protein, 510 aa, Listeria innocua Clip11262
MEFWRGSVFYEIYMKSFQDSNGDGLGDFKGLTSRLDYLVDLGVDGIWLTPFYPSPQVDNGYDVSDYCDINPDYGNMADFREFMKAADARGIKVIIDLVLNHSSTEHAWFKESRSSKTNPKRDYYIWREKPNNWESFFGGSAWELDKLTGEYYYHSFAKEQADLNWANPAVRAEIEQVLAFWLNEGVAGFRLDVINNLTLVLEFPDNPVVDNEMEHVYDRNQQGLEQALEQIAAFCRKEREVFLVGEISSDKLPEIAKYSSKTMLDVTFNFNFGSVELLDAQSVFTTLNEMETALQEGQWPTLFFGSHDMSRFTTRLSNGNLSKTKLLAFLMLTAKGIPFIYYGEEVGMPDLTFSSVEEMRDIQGTAAYYQALQAGSDEQSALELAINKTRDKARGPMVFPDGKPFTTGQPWIKMASLNEEDALSMWHFYQALLAFRKGHDFKEKEYASLTLDGETLSYQRGEFLFLLHFGETEVTYPLQEKSELVFGDAEMLEADVKMGAYAGIALRVED

SEQ ID NO: 13313 - protein, 449 aa, Listeria innocua Clip11262
MEKHYDYIAIGGGSGGIASINRAAMHGAKCALIEPKFLGGTCVNVGCVPKKVMWYGAQIKEAMDLYADAYGYQVDSSFNFQKLVENREAYIERIRGSYKNGLDNNKVEWIKGYAEFVDEKTLRVNGELVTADHILIATGGEPALPSIPGAEYGITSDGFFALKELPKKVAVVGAGYIAVELAGVLQQFGSDTHLFVRKHAPLRNFDPILTDTLTELIEQSDMTLHKHAVPQKVEKNSDGSLTIFLEDGRTETVDTLIWAIGRKPVIKGLQIEKAGVELVDSGHIAVDKFQNTNVDGIYAVGDVTGHYELTPVAIAAGRRLSERLFNNKKDAHLTYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 13314 - protein, 488 aa, Listeria innocua Clip11262
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 13315 - protein, 483 aa, Listeria innocua Clip11262
MFENYQFPKDFLWGGAIAANQAEGAFKVDGKGISLADLHKYHKGKTNDEISEEQHKGVSLADIKASIEDKVNYYPKRHGIDFYHTYPEDLALLAEMGFKTFRTSIDWTRIFPTGEEEEPNEAGLKYYDQLIDKIIELGMEPIITILHYETPVEIVLNHGGWHNRKVIDLFEKYGKTVLDRYSKKVKYWIVINQINLIQFEPFNSTAIPYDAVDDYLSATYQAVHNQFVASAKIYEYGKALNPDLMIGTMLADCTAYPYSCDPDDIVLAMKRNRMEYFFADVQFQGEYPQYALNYLAENNITIEITEEDKAILQKNTMDYLALSYYYSQMVDSKKNDLDPASITPNPHLKANPWGWAVDPKGLYNALSQYWDRYHKPIIIAENGFGMYDELDNGEIHDDYRIDYLSAHLKEMKRAMYDGVEVIAYCAWGPIDIVSCSSAQMEKRYGFIYVDLDNEGNGTGKRIKKDSFSWYKKVIESNGEDLEV

SEQ ID NO: 13316 - protein, 158 aa, Listeria innocua Clip11262
MNVHDFSEKAMNGKEIALSDYKGKVLLIVNTASKCGLTPQLEGLEKMYKKLGGDNFEILGFPCNQFLRQDPGSDEEILEFCQMNYGVTFQMFSKIKVKGKDAAPLYKYLTEQTGGKKVEWNFAKFLIDENGEVVERFPSKMKPEDFEDKVEALVAAVK

SEQ ID NO: 13317 - protein, 286 aa, Listeria innocua Clip11262
MEKIGFVGTGVMGSSMAKHLLEAGYEVHIYTRTKEKAEALLSQGALWESDPGSLGAKVDILISMVGYPKDVEQLYLGENGFLDNLKAGSVAIDMTTSSPALAKKIAEAGHEKGIGVLDAPVSGGDIGAKNGTLAIMVGGAEDVFLKVKPIFEILGSSVILQGDAGSGQHTKMVNQIAIASNMIGVTEAIIYAERAGLNPSRVLDSISGGAAGSWSLTNLIPRVLQDDFSPGFFIKHFIKDMGIALSEAKQMGLELPGLTLAEQMYQTLAEQGLSEEGTQALIKYYR

SEQ ID NO: 13318 - protein, 467 aa, Listeria innocua Clip11262
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 13319 - protein, 496 aa, Listeria innocua Clip11262
MTNLFQDDSLTLHTDLYQLNMMKAYFDDGLHERRSVFEVFFRDMPFDSGFVVFAGLERIINYMQNLRFTETDIAYLHDELGFDGPFLEYLRNFKFKGNILAAKEGEFVFKTEPILQVEASLAEAQLIETALLNIVNFQTLIATKAARIRSVIDDETFAEFGTRRAQEMDAAIWGTRAAYIGGCDSTSNVRAGKIFGIPVSGTMAHAMVQAYRDELEAFRSYAKTHFDSIFLVDTYDTLKSGVPNAIKVAKEMGDKINFIGIRLDSGDMAFLSKKARQMLDEAGFTEAKIFASSDLDEHTILSLKAQKAKIDSWGVGTKLITAYDQPALGAVYKMAAIADENDILQDSIKLSSNTEKVSTPGKKKVYRIITNEDGLKAEGDYIALADESLENVDKLTMFHPVHTYIMKTVENFTARELLVPIFKDGELVYDMPTLDEIKAYKEENLALLWDEYKRTVRPEQYPVDLSVKCWKNKMRNIEKVRKSVQLHSPVELDMPF

SEQ ID NO: 13320 - protein, 234 aa, Listeria innocua Clip11262
MSAYLAEFIGTMVLIMFGNGLLAGLTLNKSLSQGANWVVVTFGWGFAVMIGIYVAGAYSGAHLNPAVTIALAVGGSFSWAAVVPYIIAQIAGAFVGASIIILHYYPHFKATPQEIDTHGIFSTGPAIRNTPFNLISEIIATFAFIFGLLMIGENSFTNGLNPLILGFLVVAIGMSFGPTTGYAINPARDLGPRLAYFLLPVPNKSGSDWRYAWIPIVGPIIGGLLAIGLFNILL

SEQ ID NO: 13321 - protein, 444 aa, Listeria innocua Clip11262
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAITACDSIQTFKLVVKTIARKHGLHATFMPKPLFGVNGSGMHFNMSLFTEEGNAFFDKEGELELSKTAYHFLAGMLKHARGFTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIRDGLGEHIFEHFIEAKTIECDMFRTAVHPWEREQYLEIY

SEQ ID NO: 13322 - protein, 475 aa, Listeria innocua Clip11262
MATEYDVVILGGGTGGYVAAIQAAKNGQKVAVVEKGKVGGTCLHRGCIPTKALLRSAEVLQTVKKASEFGISVEGTAGINFLQAQERKQQIVDQLEKGIHQLFKQGKIDLFAGTGTILGPSIFSPTAGTVSVEFEDGSENEMLIPKNLIIATGSKPRTLNGLTIDEENVLSSDGALNLETLPKSIIIVGGGVIGMEWASMMHDFGVEVTVLEYADRILPTEDKEVAKELARLYKKKKLTMHTSAEVQAASYKKTDSGVEIKAVIKGEEQTFTADKMLVSVGRSANTENIGLQNTDIATENGFIQVNDFYQTKESHIYAIGDCIPTIQLAHVAMEEGTIAANHIAGKETEKLGYDLVPRCIYTSTEIASVGITEEQAKERGHDVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 13323 - protein, 472 aa, Listeria innocua Clip11262
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 13324 - protein, 446 aa, Listeria innocua Clip11262
MTEFTYDVVIIGSGASGTTVAFEAQAAGLKVAIVEERSWGGTCVLRGCDPKKVLVGAAEARNLSTRLRGKGIKEAATISWTDLMAFKETFVEDVPESRLESFQEAGIETFFGPASFQNENTLQVGNDILSAKKIVIATGATPNTLKVEGQEHIQTSDDFLSLEKLPDSVVFIGGGYISFEFASIALAAGRDVHIIHHNSEPLKKFDPDFVAALVATLKEEGIHFHFDTDITKINKNGEKLHIEGKNGFSLETDLIIGATGRTPNIAHLALDKANIDYTKKGITVNEKLQTPNHPHIYACGDVAATKGAPLTPVVSMEAALVAKNILGGNEKIDYPAIPSVVFTSPKLASIGISMEEANANPEKYQIKNHDTTNWYTYRRTNEKIALAKIIEDRETGQIKGAHFLSEEADYMINYIAILMKANLTLADLQSVIFAYPSPASDLTALN

SEQ ID NO: 13325 - protein, 376 aa, Listeria innocua Clip11262
MAKRDYYEVLGISKSASADEIKKAYRKLSKQYHPDINKEAGADEKFKEISEAYEALSDPQKRAQYDQYGHVDPNQGFGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 13326 - protein, 282 aa, Listeria innocua Clip11262
MKIAYLGPAASFTHAAAAKAFPKEEMVAKSTIPDCIMAIEKEDVDVAVVPIENTIEGSVNITLDYLFHFSSVPVVAEIVLPIAQHLMVHPAHKATWKSVQKVMSHPQALAQCHTFLQAELYGVEREVTPSTAYAAKWVSNNPTELVAAIAPRMAASEYGLEIVQENAQDLELNQTRFFVLSRKPVSILLPKEEEKTSISVILPNNMPGALHKVLSTFAWRDIDLSKIESRPLKTSLGEYFFLIDVLSEGKETLVTNALDEIRLLGGKANKLGTYHVHRLQTT

SEQ ID NO: 13327 - protein, 272 aa, Listeria innocua Clip11262
MIDTSLATQFLGEVIGTAILIILGAGVVAGVSLKKSKAENGGWVVVTLAWGLGVTMGVYVSGYMSMAHLNPAVTIGMALAGAFPWNYVLPYIVAQFIGAFIGATLVWLHYYPHWKKTEDKPTKLGVFATAPAIRHFTSNFFGEALGTFMLVFGLLSLGANSFSDGLNPLVVGALIVAIGMSLGGTTGYAINPARDLGPRIAHFVWPISGKGGSDWGYSWVPVIGPIMGGALGALGYNAIINGELGMWFWVFAVLFVLILILTMQLDKKKDLA

SEQ ID NO: 13328 - protein, 429 aa, Listeria innocua Clip11262
MQNYIKSEKAFKEAKKVLPGGVNSPVRAFNSVDASPVFMDHGKGAYITDVDGNEYIDYVLSWGPLILGHADPSVVNAITNSAMKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDVEGAKLAFEKFGEEIAAVIVEPVAGNMGVVPPIDGFLEGLRELTTEYGALLIFDEVMTGFRVDYYSAQGYYVVTPDITCLGKVIGGGLPVGAYGGKKEIMEQIAPAGSIYQAGTLSGNPLAMNAGFETVRQLTPQHYDVFRSLIKRMEEGLTEISNRHEVPLSINKAGSMFGFFFTDQKVTNFDTAKTSDLEFFRNYYREMLAQGIFLPPSQFEGVFISTMHTEKEIDATLEAFDVTCKMLRG

SEQ ID NO: 13329 - protein, 294 aa, Listeria innocua Clip11262
MLGDLFTKPKKRKYATIPSDGTKADVPEGIMTKCPECKKIMYTKELQKNLMVCNYCGFHHPIGATARIDMLVDEGSFEELDANLTTANPLGFENYMDRIEKDKQKSGLNEAIVTGHATIDGNPLVIAVMDSRFRMASMGSVVGEKILRGVEEADKTNKPFVIFTASGGARMQEGMLSLMQMAKTSAAFKRFSNHGGLVITVMTHPTTGGVSASFASLGDYNFAEPGALIGFAGRRVIEQTVREELPEDFQTAEFLLKHGQLDDCISRLDLKNKLSFILKIHVKTPEAGGESDGE

SEQ ID NO: 13330 - protein, 384 aa, Listeria innocua Clip11262
MKHVFPTYNRFPVDIVKGNGTVVKDATGKTYLDFTSGIAVCNLGHCPENVTEAIQSQLANIWHTSNLYECALQDSVAELITDGTDKLVFFCNSGTEANEAALKLARKYTGKEKIITFEKSFHGRTFGSMSATGQAKIHQGFGRLVPGFTYVPYNDIESFKTELDENTAAVMLEVIQGEGGVIPGNAAWLMEVQMLCKKAGALLIIDEVQTGLGRTGTLFGFQQTFLDPDIFTLAKGLGNGLPIGAMVGKEHLSSAFGPGSHGSTFGGNKLALAAAKEILLTMKQTGFLEEVNAKAAYFRNLLEEHFEQLENVVAIRGEGFLIGIELGSSAAPVVTELRDKGLLILTAGPNILRILPPLTVSYAEIDQAISILKSVLEKQLIGSE

SEQ ID NO: 13331 - protein, 276 aa, Listeria innocua Clip11262
MKKITPKAMCAWIPKREDETHKGDYGRVLIVAGNKQFGGAAIMAAEACVKSGAGLTTVASDSVNRPALQTRIPECMFIDYENITSLSEQINHFDTILIGPGLGLDAYAEEIFRLVLQNSTEHQQLIIDGDGITIYAKGENPHPAAKLTFTPHAGEWERLKALAPEAETPTDVALHIDATIVLKGHRTKVYSGESAWQNMYGTPAMATGGMGDTLAGTICGLMAQTEKPLTGTLAAVFLHSYIGEILAKKRYVVLPTEIAEELPTYLKIFSETDEHA

SEQ ID NO: 13332 - protein, 257 aa, Listeria innocua Clip11262
MTKTLTKKLANKDHASVVTYIMGGDGGLDNLEEQLLFLEKSGVSAIEIGIPFSDPVADGPVIQLAGLRALKERVSLEAILTKLATSKVQIPLIIMSYINPIFHLGIPKFIEMVQKTPVKGLIIPDLPYEHRTLITPELKGTDIALIPLVSLTSPKERLEEIANQAEGFIYAVTVNGTTGVRNEFNTHIDTHLAYLKSISPVPVLAGFGVSSIEHVEKFARVCDGVIIGSKVVQMLHDGETRELGTFLQNAAEVQIEN

SEQ ID NO: 13333 - protein, 469 aa, Listeria innocua Clip11262
MDMTNWLQKRVRLSPGETALVFEGKQETFEEIYEAVEKLAGKLFARGIRKDEMVALLGKNDRMTFLLIHALQQLGAITLFLNNRLTKKEITFQLANAEVKQVIVADAFVDKVTSGISYEELQQTTYVEPDLCKTWDLSRTASVMYTSGTTGKPKGVMQTYENHWWSAVSSVLNLGLTEKDSWLCAVPIFHISGLSIMMRSVIYGIPVYLEEHFDEEKITQLLESGKISTISVVTSMLERLLKIQGGSYHPNVRTVLLGGGPANKAVLEICKQRDIPLVQSFGMTETASQIVTLPPKDALNKIGSSGKALFPAEVKIADDGEILLKGPSITPGYLHNEKATAKAFIDGWFKTGDIGYLDEEGFLFVLERRSDLIISGGENIYPTEIEHVIGAYEAVEEVAVVGKSDAKWGSVPVAFIVVNEGFDEGVLKDICQTNLASFKIPKQITIVEHLPKTASGKIQRNKLKERHSN

SEQ ID NO: 13334 - protein, 432 aa, Listeria innocua Clip11262
MDHSMSKKLHDEALLHIVGGVNSPSRSNKGVGGGIPVTMERANGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTRSTAEEVITVPFNDLTSFKEALAVWGDQVAAVLVEPIVGNFGMVAPAEGFLEAVNELAHENGSLVIYDEVITAFRFMYGGAQNYLGVIPDLTAMGKIIGGGLPIGAYGGRVDIMEKVAPLGPAYQAGTHAGNPASILSGIACLEVLQEEGLYDRFEKYGSMLKEGIEKAAIKHGIAVTVNQIVGALTVYFTDEPVTNYAEAGATNGDLFGRFFKGMLEEGINLAPSKYEAWFITSAHSEADILETIQAVDTVFGKLVQGK

SEQ ID NO: 13335 - protein, 489 aa, Listeria innocua Clip11262
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPQPPKKRTGKRIAVIGSGPAGLACADQLNKAGHSVTVIEKSDRIGGLLMYGIPTMKLEKEQVTRRVNLMAEEGIEFVTGVAAGTDVTFAELRAEYDSIVLATGAGNARDIPLAGRDAAGIHFAVPYLTQSTRDNLDNGGVQTLSAKDKNVVIIGGGDTGADCVATALRQGAKSIYQFGIQDKLPELRNGENPWPQYPRVFKMDYAHEEAEAVYGRDPREYLINTTSFEKDAAGNLVGLHTVEVTEDKETRQYTPVEGSEKYFEVDMVLIAIGFSGTTEDIFTNFGVGKTERHTIDAAKGFYRTSEEGVFACGDARHGQSLVVTAIAEGREAAREVDFYLMGETFLP

SEQ ID NO: 13336 - protein, 509 aa, Listeria innocua Clip11262
MKRALISVSDKNGIVPFAEKLVELGVEIISTGGTKAAFEQAGVPVTGIEAVTEFPEMLDGRVKTLHPAIHGGLLARRDTAEHMEAIAAHDIKPIDLVIVNLYPFQETIQKPGVTLEEAIENIDIGGPSMLRSAAKNYAAVTVVVDTADYDTVLTELQEHGATTFETRQRLAAKVFRHTAAYDALIAEYLTDVTGETFPEKVTLTYNRKQVLRYGENPHQDAAFYTEPRAIENSISAAKQLHGKELSYNNIRDADAALKIASEFKEPVAVAVKHMNPCGVGVGETIEEAYLKAYEADEISIFGGIVALNKEVDAKTAEHMSKIFLEIIIAPSFSEAGFAILAKKKNIRLLTVPFAGNVEGFEKTSVNGGLLIQANDALVEDTTSYEVVTEKQPTNSEMKALLAQWKIVKHVKSNAIVVGSDKQTLGIGAGQMNRIGSALIALEQAGEKAKGAVLASDAFFPMDDTVEAAAKAGITAIIQPGGSIKDKESIAMADKYGISMVLTHVRHFKH

SEQ ID NO: 13337 - protein, 218 aa, Listeria innocua Clip11262
MGKIAPSILSADFANLARDIKEVENYGADYIHVDVMDGHFVPNITFGPAVVKAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 13338 - protein, 427 aa, Listeria innocua Clip11262
MQKFFNKVFRLNEHKTNIRTEFLAGMIGFFTVAYIIVVNSSILAEAGVPYQGAVLATIFISALGCLIMGFWANAPLILMPGMGINALFAYTLVQGMGLSWQVALAAVTMSGLLFMILAFTPLAGKLNKAIPLILKQAITVGLGIFLIFLGLEKGGIVTSGKHAIIAVGDLSDPFVLATLVTLLLTMILVIRKIPGTFLWSLIIGTLVGVMFGVTGKADGASISVAPWSDVLFKADFSGMASVSFWSAVFTMTMVIVFETVGLTNGQVRQLKQTEKLPRVLKASSLTAFLSGLFGTSPTISALESGSMFASGAKTGLATITTGLFFIASLFLMPVLSFIPNSAIAPILVVIGMSMLQEFKEMDLSNPAETFSALLIIVLIPLTYSIADGIAAGFIAYPILRAFTKNEERTSPVMYVIAALFLLQFIIQ

SEQ ID NO: 13339 - protein, 456 aa, Listeria innocua Clip11262
MQQTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPTILTHMPVTAEVAHIARHFLNGICIGIPAFFISAILRSFIDSLGLTRVTMLITLCTVPFNIFLNYCFIFGNFGFPEMGGAGSGYATGITYWLVVLVSVILIQTQTRLRKFGIFKGLTALRFSKVKEIIGIGVPNGLTILFETSIFSAVTILMGAFGTETIAAHQSANSVCTLLYAFPLSVASTLTILGGYETGAKRLKDAKQYRHIGMTAAILIGCINGAILFFFRDIIAGFYTNDAELSDLIMHFLVYAILFQFADAVLSPVLGALRGYKDVAITSIIAFISYWLIGLPVGYGLSFTNLGPFGYWIGLSTGLFVAAFILSIRVRKTERKLSLNAKNAEISS

SEQ ID NO: 13340 - protein, 263 aa, Listeria innocua Clip11262
MKVAVSGFKGRMGHEVVKTILREEDLELVAVLDHEPKEKNIREIVEFSSLDVPVYGDLSEMLEEIKPDCVVDFTIPKVGYSNTKTILEHSVRAVVGTTGFTPEQISELKSIAESKKIGALIAPNFAVGAVLMMQFAQKAAKYFPNVEIIELHHDNKLDAPSGTAVKTAEMMAETREFVKQGAADEVELIEGARGGEYEGMRIHSVRLPGLVAHQEVIFGAEGQGLTIRHDSYDRISFMSGVALSVRKTKELETLIYGLENILD

SEQ ID NO: 13341 - protein, 331 aa, Listeria innocua Clip11262
MEYVKFGNTGMDVSKICLGTMGFGDKDKWIHKWVLDEANSRPIIKKALDLGINFFDTANIYSYGESEKIVGRALKDYANRDDIVLATKIHQTMRPDRPNSGGLSRKTILSEIDHSLKRLETDYVDLYIIHRFDENTPIEETMEALHDVVKSGKARYIGASAMYAWQFQKAQRVAERNGWTKFVSMQNHYNMIYREEEREMIPFCRDEKIAITPYSPLASGRLTRDFAETTNRSETDPIQKSKYDGMMNSDKGIIERVAELALEHEVSRDKIALAWLLNKDEITSPIIGAQKESHLESAIGALDIKLTEAEVNYLEELYIPHPVVGALPTSK

SEQ ID NO: 13342 - protein, 347 aa, Listeria innocua Clip11262
MKNAIKWIAIGFAGIILLPLVIVFFIYKKAVGKKEYDPEVLENLDEASQEFVKNTSPLSDVDSRYKYMRLATKALPSAKDIEIGDVENKKIDGPAGKIPIRIYTPKEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKAKGKPNVTAQILLYPATDIFSRDASVLYPSMDEFAEGYVLTKESLDKFFKLYIANSSDRKYDPLIAPIRSKDLAGLPKTFIATAEFDPLRDQGEAYAKKLKDAGVEVFAKRFEKVPHGFMTTTSEATDETYELISEFLEEK

SEQ ID NO: 13343 - protein, 229 aa, Listeria innocua Clip11262
MKLVLIRHGQSEWNKLNLFTGWHDVDLSEEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKAGRRVVIAAHGNSLRALVKFLEGISDDEIMELEIPTGVPLVYELNDDLKPVNKYYLDK

SEQ ID NO: 13344 - protein, 430 aa, Listeria innocua Clip11262
MFQLKANGTDVKTEVISGFTTFLTMVYIVVVNPAILSAAGVPFNTVFMATIISAVIGTLWMAIFANYPIAIAPGLGMNAYFVTVVTTQKLDYSVAFAAVFVAGIIFLLLSLTPLREKIIEAIPHNLKAGITAGIGLFIAFLGFRMTGIIVSNDSNLVGLGDLHSKEAILAIVGLLITLILLALNVKGALFIGMIATGIIAFITGELKFTEGIVKLPPMPEFVFTNPIHAFGDVMSYGLYAVVLSFLLITIFDTTGTMIGVAKKAGLMKGESLPNAKQALMADAVATSVGSMFGTTPTSAYIESSAGVATGGRTGLTTLTVAILFMVSAFFAPLVGAVSGISAITAPALIIVGSMMIGAVKEIDWDTLDEAFPAFLVILAMPLTSSIAIGLAFGFISYPVLKVFTGKWRELNWFLIVIAVLFFILVAFLPH

SEQ ID NO: 13345 - protein, 259 aa, Listeria innocua Clip11262
MITIKNIQKSFGQNQVLKGIDLTVKKGEVVTILGPSGSGKTTFLRCLNLLERPENGEISMHDQIINCKKPSKKEVLQLRKNTAMVFQQYNLFSHKTVIQNVMEGLTVARKIPKKIAREIAERELTKVGLADKFSAYPSQLSGGQKQRVGIARALAINPDVILFDEPTAALDPELVGEVLEVMLEIARAGATMIVVTHEMEFAKRVADQVVFMDGGLIVEQGTPDEVFNHTKEERTKRFLHRVSADYLYEIKEVKKERVI

SEQ ID NO: 13346 - protein, 450 aa, Listeria innocua Clip11262
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLADNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEEVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 13347 - protein, 430 aa, Listeria innocua Clip11262 [sequence omitted]

SEQ ID NO: 13348 - protein, 510 aa, Listeria innocua Clip11262
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLKPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 13349 - protein, 251 aa, Listeria innocua Clip11262
MRKPIIAGNWKMNKTAAKAGQFAEDVKNNVPSSDAVESVVAAPALFLQELVRLTEGTNLRVAAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 13350 - protein, 396 aa, Listeria innocua Clip11262
MAKKVVTDLDLKNKKVLVRVDFNVPMKDGKITNDNRIVAALPTIEYILEQNGKAILFSHLGKVKTEEDKEGKSLRPVAARLSELLGKEVKFVPTTRGPELEKAVDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 13351 - protein, 463 aa, Listeria innocua Clip11262
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYNPSAGTYFDLLAFVVVMVIGILLSFGIRESTRVNNIMVLVKIAVVVLFIIVGAFYVKPDNWTPFLPFGVQGVITGASTVFFAYIGFDAVSSAAEEVKNPQKNMPIGIIASLAVCTLLYILLSAVLTGVVPYTDLVGVSAPVAFALQAINQNWIAGLLSVGAIVGMTTVVLVMSYGGTRLLFAMGRDGLLPKSFSKISKNDTPVRNTMIFATVMGLIASTVPMEDLAQLINIGTLFAFAMVSVGIFFLRRNPELNQKGFKTPFYPVVPALSFLLCVYLMLNLSKTTWIAFGVWFVLGIIVYTFYGRKHSALRLK

SEQ ID NO: 13352 - protein, 338 aa, Listeria innocua Clip11262
MSKLFSEYKLKDVTLKNRIVMSPMCMYSVENKDGIATDFHFAHYVSRAAGGTGLVILEATAVQEVGRISEFDLGLWNDEQVPALKRLVDGLHYHGAKAGIQLAHAGRKAVLPGEIVAPSAIPFDEKSAKPVELTKEAIKEVVADFKRAAYRAKEAGFDVIEIHAAHGYLIHQFLSPISNRREDNYGGPAGNRYKILSDIIKAVKEVWDGPIIVRVSATDYAHGGLQLEDHIPFAKWMKADGVELIDVSTGGLVNVEPPVFPGYQVPFADEIRRGAGIATGALGLITRGEQAEEILCNERADLIIIGRELLRNPYFAKEAAETLGETIEAPKQYSRAWK

SEQ ID NO: 13353 - protein, 215 aa, Listeria innocua Clip11262
MKLVLMGLPGAGKGTQAEQIVEKYNIPHISTGDMFRAAMKNNTELGKKAKSFMDNGDLVPDEVTNGIVRERLAEDDAKNGFLLDGFPRTVEQAEELENILSDLGTELDAVINIEVDKDVLMKRLTGRWICRTCGKTYHEIYNPPKVPGKCDLDGGELYQREDDKKETVENRLNVNMKQTKPLLDFYSEKGKLHSINGEQDINDVFVDVEKILASF

SEQ ID NO: 13354 - protein, 214 aa, Listeria innocua Clip11262
MTFVAPSLLAADYMNMANSIKEAEQAGADYLHIDVMDGHFVPNLTFGIDMVEQIGKTATIPLDVHLMLSNPENYIEKFAAAGAHIISVHIEAAPHIHRVIQQIKAAGCKAGVVLNPGTPASVLDAILGDVDLVLQMTVNPGFGGQSFIDSTIENMRYLDNWRQENNGSYVIEVDGGVNAETAEKCKQAGVDVLVAGSYFFGADDKVACVQGLKK

SEQ ID NO: 13355 - protein, 224 aa, Listeria innocua Clip11262
MRKIAASIMCADQLHLGEELRRLESAGVELLHCDVMDGIYVNNLALGPEYLEIVRNNTEIPLDIHLATITPLKYIDMYATAKPEYISFHVEVAEDVSEVIQKIRSYNIKPSIAINPETPIEAIYPYLDEVEMVLMMTVNPGFAGQKFQTDVLPKLHDLKAKLEGKVHAPLIEVDGNINKETVGLMRDCLPDIYVLGTSALFHDRDKTSYAERLVHIWSDVEKHV

SEQ ID NO: 13356 - protein, 343 aa, Listeria innocua Clip11262
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTICPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFIQVGLFAEKKNAIDEESIIQREIAYIGSRSQKPSSWILALDLLANGKINTDKMITKVYGLDDWREAFEAVMAGNEIKVLVKS

SEQ ID NO: 13357 - protein, 488 aa, Listeria innocua Clip11262
MWETKFAKEGLTFDDVLLVPAKSDVLPNDVDLSVEMAPSLKLNVPIWSAGMDTITEAKMAIAIARQGGIGVVHKNMSIEQQAEEIEKVKRSESGVIIDPFYLTPDHQVFAAEHLMGKYRISGVPIVNNEKERKLVGILTNRDLRFISDYSTVIKDVMTKENLVTAPVGTTLKQAEQILQKHRIEKLPLVDEAGILKGLITIKDIEKVIEFPNSAKDKHGRLLAAAAVGITNDTFVRVEKLIEAGVDAIVIDTAHGHSAGVINKISEIRQTFKDVVIVAGNVATAEGARALFEVGVDIVKVGIGPGSICTTRVVAGVGVPQITAIYDCATVAREFGKTIIADGGIKYSGDIVKALAAGGNAVMLGSMLAGTDESPGETEIFQGRQFKTYRGMGSLAAMEHGSKDRYFQADAKKLVPEGIEGRVPYKGSVADIIFQLVGGIRSGMGYTGSPDLRHLREEAAFVRMTGAGLRESHPHDIQITKEAPNYSIS

SEQ ID NO: 13358 - protein, 484 aa, Listeria innocua Clip11262
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRQVIEDFTNYSALLFERFNGRVKYWVTLNEQNVFISHGYKLAYHPPGVSDDKRMFAANHNANLANASAIAKFRELGISGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 13359 - protein, 477 aa, Listeria monocytogenes EGD-e
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 13360 - protein, 327 aa, Listeria monocytogenes EGD-e
MKKRQLGNAGLVTSELGFGCMGLNYHRGPAKDRNEMIEVVRTAMDAGITMFDTAEVYGPYTNEELVGEALVGKRNHVQIATKGGFKINGLNNEVDSRPESIKAAVEGSLKRLKTDYIDLYYIHRIDPSIPIEEVAGTIQNLKQEGKILHWGLSEASAKTIRRAHKVEPLAAVESEYSIWWREAEKEVFPVLEELGIGLVAYSPLGRGYLTGKLDINADFNANDNRGGLPRFQKEAMEANQVLLDFMKEIADEQNVTTAQLALAWILDQKPWIVPIPGTTRPSRIEENIASTEIHFDDGARQKIADALSQIEIVGDRYSAAENKRIGK

SEQ ID NO: 13361 - protein, 371 aa, Listeria monocytogenes EGD-e
MDYEKALAFIKSNSTLEQEEGTEVIFKQAQETARGNLDPFLLKDLKQHLGGTNDAIKEAPQEIQMPDFSNLEIATAAALQMRATMGSPNIDLSNGVTTEYRVVEGDYGDIPVRIYRHEEATKPVPAFIFYHGGGFVGGTPAVVENFCKGIAEKLPAVVINVDYHLAPEFPAPAAPKDCYRVLEWVVEQSNELGIDASKIGVSGDSAGGTLAAAVSYMDYEAETNYVGFQALLYPALTLVDEDNDKYQWDISKFGASEDTLPLVAPGIIGMNSSGELLRKAYVRDENPAAPIYSPLSAVDKSIYPPTLIASAEFDALRAFADVFAKELRASGVQTKAIVYQGMCHAFIDKYGIFPQAEDVADEIVQMMKEIF

SEQ ID NO: 13362 - protein, 502 aa, Listeria monocytogenes EGD-e
MAFYFEEPSRTFSEFLLVPGYSSAECVPTNVSLKTPIVKFKKGEESAITMNIPLVSAIMQAVSDDNMGIALATEGGVSFIFGSQSIESEAAMVSRVKNHKAGFVISDSNISPDKTLQDILDLKEKTGHSTVAVTEDGTAHGKLLGIVTSRDYRVTRMSPDEKVADFMTPFEKLVTANKSTTLKEANNIIWDNKLNALPLVDDNEHLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 13363 - protein, 308 aa, Listeria monocytogenes EGD-e
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 13364 - protein, 457 aa, Listeria monocytogenes EGD-e
MAKAKRTTKFVCQACGYESAKWMGKCPNCNEWNQMVEALEPSKKSRSAFNHTGEPSKATPITQIASETEKRVETNMPELNRVLGGGVVPGSMVLVGGDPGIGKSTLLLQVSAQLTLTNKKVLYISGEESIKQTKLRAERLQVSGDNLYVYAETNLEAVQETIDFVKPDFVVIDSIQTVYHSDVTSAAGSVSQVRECTATLMRIAKMQNIAIFIVGHVTKEGAIAGPRLLEHMVDTVLYFEGERHHAYRILRAVKNRFGSTNEMGIFEMRDVGLVEVANPSEVFLEERLEGASGSTVVASMEGTRPVLVEIQALVSPTMFGNAKRMATGIDYNKVSLIMAVLEKRVGLMLQNQDAYLKAAGGVKLDEPAVDLAVAVSVASSYRDKPTRSTDCFIGELGLTGEIRRVARIEQRVQEAAKLGFKRIFIPKNNEGNWKIPKDVQVVGVETIGEALKKALPD

SEQ ID NO: 13365 - protein, 486 aa, Listeria monocytogenes EGD-e
MTEVKKQFPKGFLWGGATAANQVEGAYDVDGKGLSTADMVKFIPKEERTKDLELDVSKAEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSFMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLMGYTSWGPIDLVSASTSEMSKRYGFIYVDQDDWGKGTLERSRKDSFFWYKKVIETNGEDLD

SEQ ID NO: 13366 - protein, 478 aa, Listeria monocytogenes EGD-e
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLQFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 13367 - protein, 338 aa, Listeria monocytogenes EGD-e
MIELHQVSKSFNVNGKTVEAVKNVSITVEKGEIFGVVGYSGAGKSTLVRCINLLERPDAGQVVIDGKNLSTLSSKELRVARRKIGMIFQGYNLLKTATVYDNIAKPLKLEGVPKNEIETRVNKYLSIVGLEDKRNNYPSQLSGGQKQRVAIARALAHEPEILLSDEATSALDPETTEAILQLLLKINAELGITIFLITHELDVIQRICDRVAVMENGHLVEQGTVLDIFTKAKHATTKRFVGSEASFDIPQDLLEKYVATGKLVSLHFIGDEADEPALALVSRKFDVLPSILAGGIDHLKNGTLGKLLVHLKGDEVEYSKAISYLKESGVVVEEVELL

SEQ ID NO: 13368 - protein, 393 aa, Listeria monocytogenes EGD-e
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQACVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 13369 - protein, 463 aa, Listeria monocytogenes EGD-e
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGIDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 13370 - protein, 471 aa, Listeria monocytogenes EGD-e
MHTNTGFPADFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFDWYKNVIATNGEDL

SEQ ID NO: 13371 - protein, 254 aa, Listeria monocytogenes EGD-e
MRKPLVGINMKNYINTRAQTSEWLEATIPLLGNFSDVDTFIFPSMGTLETTANLLAGTSFGFGPQNMAPEKSGPLTGEFSVESIIDLSANYVEIGHAERKNLFHEKTSEIAKKIQLALDEKITPVVCVGEGIRANDTNELKNALKKQIEALFDTIQVTQFKNVVLAYEPEWAIGKANSADTDYIESAHQALREIIRELGGDETLVRIIYGGSVSKENAAEIVRQKNVDGLFVGRFGHKPQNFADIVSIVSKTKG

SEQ ID NO: 13372 - protein, 480 aa, Listeria monocytogenes EGD-e
MKELLTFPKDFWWGSAWSAEQAEGRGDTGKAKTVWEHWFETEPNRFYEGVGSEITTDHFNRYKEDVQWMKKTGQNSFRISISWARMFPDDGVGEVNQKAIAFYRDLLTEMNENGVKPFANLYHFDMPVALQDAGGWESREVVDAYVHFADTCFKEFGDLVYHWFTFNEPLGPILGGYLEGFHYPNQIDFKRGTQAGFNTILAHTLAIKAFKKINLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 13373 - protein, 488 aa, Listeria monocytogenes EGD-e
MADVRKLKNYIDGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 13374 - protein, 325 aa, Listeria monocytogenes EGD-e
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAQSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 13375 - protein, 222 aa, Listeria monocytogenes EGD-e
MKMIAASIMCADSLHLADELRALEQANVKMLHCDVMDGVFVENAAMGAYVLQDIKNNTKMLLDIHLATVNPDKFVDLYAAIKPAYMSFHLEASRDVNATINHIRELGIRPSIAISPDTEIEQIYPFLGKVDMVLMMTVNPGFAGQKFQHHVLEKIKKLQKELESHTNKPLIEVDGNIFEETVRLLEPIGADVYVVGTAALFNEKAGSYTEKLAPLREIIQER

SEQ ID NO: 13376 - protein, 216 aa, Listeria monocytogenes EGD-e
MAKIVPSVFGADIGRINEQLQVLEKNDIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNDELAKECTLAGADLIVVGSYLFEGDIEANLEKLAKGVLTE

SEQ ID NO: 13377 - protein, 348 aa, Listeria monocytogenes EGD-e
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPNELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 13378 - protein, 105 aa, Listeria monocytogenes EGD-e
MISVDFSKGLVPTIILDDQNGDVLMLAYMNEESYQKTLETGYTWFFSRSRNELWNKGATSGHTQKVKQIWTDCDNDTLLIRVTQIGPACHTGKKSCFFNLIKEDF

SEQ ID NO: 13379 - protein, 431 aa, Listeria monocytogenes EGD-e
MDKFFKLRENKTTVRTEILAGLTTFLSMAYVLFVNPSMLATTGMELKAVFVATILASVVGSLAMGLIANYPIGLAPGMGLNAFFAYTVCAQWGIPWQTALAGVLVSGLVFICLTISGLREKIVNAIPTELKFAVGAGIGFFIAFLGLKNAGIIVPNESTIVALGDLHSGPVLLAVFGIVVTVAYMTIGWKGAIFFGMATTAVAGMLFGLIDVPTQVVSSVPSMESTFGQAIIHLPDIFTPQMLIVILTFFFIDFFDTAGTLVAVATQAGFVKDNKIPRAGRSLFSDSLATVFGAIFGTSTTTSYVESTAGVAVGGRTGLTAVVIAICFSLSLFFSPLLGVITSAVTTPALVIVGILMIGNVAHIDWTKFEVAVPSFFVILMMVLTFSIATGIAIGFIFYPITMVLKGRYKEVHPIMYVMMVLFILYFMFVV

SEQ ID NO: 13380 - protein, 464 aa, Listeria monocytogenes EGD-e
MTYKFPENFWWGSAASGPQTEGAADVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPTDLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGANCHGYHLWTFMDCWSWANAYKNRYGLVEVDLDNDFKRTVKASGHWYKELAENNGFED

SEQ ID NO: 13381 - protein, 305 aa, Listeria monocytogenes EGD-e
MKRITIGNSALTASEISLGCMRMADLSREDANKVINTALENGIDFFDHADIYGGGKSEEVFADAIDMNATIREKMILQSKCGIRQGFFDFSKEHIIASVEGSLKRLKTDYLDTLLLHRPDTLFEPEEVAAAFTELEKSGKVRHFGVSNQNPGQIELLKKYVDQELIANQLQFSIMHTGMIDTGFNVNMTIDPSLDRDGGILEYSRLNNMTIQAWSPFQYGFFEGVFLDNDKFPELNKTIDKIAADKGVTNSAIAVAWIQRHPASFQTVVGTMNPGRIADIAKASDVTLSREEWYEIYRAAGNQLP

SEQ ID NO: 13382 - protein, 463 aa, Listeria monocytogenes EGD-e
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPLYPVLPIVSFLLCAFLISRLSVHTWILCGIWFVIGLIVYFAYGRKHSELLKK

SEQ ID NO: 13383 - protein, 223 aa, Listeria monocytogenes EGD-e
MSKKLICPSMMCADFSGLEREVEELDKAGSDVFHVDIMDGAFVPSFGMGLQDFEEIRQKTQKLVDVHLMIMNPGDYVEMFADKGADIIYIHPEADLHPARTLDKIRNKGKKVGIAINPGTAIATIKELLPLVDNVMVMTVNPGFAGQKYLDYVDVKIAELVELKKDYTFEIMVDGAISPEKISKLSQLGVKGFVLGTSALFGKKESYAEIIKKLKQEKMEELR

SEQ ID NO: 13384 - protein, 457 aa, Listeria monocytogenes EGD-e
MFNLQKGFPENFKWGSSTNAQQFEGGYKEGGKGLSIADVRVIPDMPDESDFESFKTASDHYHHYKEDIAYYGEMGFQIYRFTMAWSRIFPNGDETEPNDAGVEFYSNMLAELEKYNIEPVVTLYAYDMPLQLLEKYNGWLDRAIIKDYLHYVETVVKLFKGRVKYWVPFNEQNFISIDSEYMSGYRAKNKAEVFQIQHHFNLCYAEATKLVHQIDPDAKVGGNIGNICPYPMTCKPEDVEASDKVAQQLGYAYGDIYFRGYYPKYFLKEYEGVDFEQIILDDDLTIIKSSEPDFMSLTYYMSSAIEAKGEEEVVVMNGIKAPNPYCETTEWGWTIDPYGFKHYLQEFYHRYQLPILILENGMGARDEKNTDDTIDDTYRIDYLASHIARMQEAVEEGCEIIGYLTWSATDLYSTREGFEKRYGFVYVDKDNSYKRLKKKSFYWYKKVIETNGNDLNY

SEQ ID NO: 13385 - protein, 458 aa, Listeria monocytogenes EGD-e
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 13386 - protein, 486 aa, Listeria monocytogenes EGD-e
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 13387 - protein, 364 aa, Listeria monocytogenes EGD-e
MTETIIRFENVTKQFDNDPPVLDNVSFEIEKGKFYTLLGPSGCGKTTILRLIAGFLEASKGQIYLGDKVINQIPANKRPVNTVFQDYALFPHLNVYENVAFGLRIKKLKKEAIDEKVKEALRFVNLKGYEKREISEMSGGQRQRVAIARAIVNEPEVILLDEPLSALDLKLRTEMQYELRDLQKRLGITFIFVTHDQEEALAMSDEIFVLNKGEIQQSGTPIDIYDEPINKFVADFIGESNIVNGKMIQDFEVEFVERRFECVDQGFRPNEVVEVVIRPEDLEITSAEKGQLQVTVDWMLFRGVHYEVGCIDIDGNEWLVHTTRKVRVGDKIGLAFEPEAIHVMRLGETEEEFDKRLDSYDEVQ

SEQ ID NO: 13388 - protein, 461 aa, Listeria monocytogenes EGD-e
MSLFSLKKKNHFVPLEIQRQQWFKHFIVAFMSVFICYLTVYLLRNNFKAAQTLLIEQNHFSTTELGMIGLAFSVMYGIGKTILGYVVDGRNAKKIMSFLLGISAIISIIIGILLVAKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 13389 - protein, 242 aa, Listeria monocytogenes EGD-e
MTKLKVTGLKKSFGANEVLKGIDIEVKEGEVVCVIGPSGSGKSTFLRCMNNLEEITAGEVVVDDFNITDKKVDINKVRENIGMVFQHFNLFPHLSVLENITLAPVELKKMDKEAAKSNALRLLEQVGLREKAEEFPNQLSGGQKQRVAIARALAMDPDIMLFDEPTSALDPEMVGEVLGVMKELAKGGMTMMIVTHEMGFAREVGDRVIFMDGGYIVEEGKPADIFDNPTNERTISFLDKVL

SEQ ID NO: 13390 - protein, 510 aa, Listeria monocytogenes EGD-e
MEFWRRSVFYEIYMKSFQDSNGDGLGDFKGLTSRLDYLVDLGIDGIWLTPFYPSPQVDNGYDVSDYCDINPDYGDMTDFRAFMKAADARGIKVIIDLVLNHSSTEHTWFKESRSSKTNPKRDYYIWREKPNNWESFFGGSAWEKDELTGEYYYHSFAKEQADLNWANEAVRAEMEQVLAFWLNEGVAGFRLDVINNLTLVLEFPDNPVASGEMEHVYDRNQSGLEQALEDIASFCRKERDVFLVGEISSDKLPEIARYSSKKMLDVTFNFNFGSVDQLDAKSVFTTLNEMETALNEGQWPTLFFGSHDMSRFRSRLASGDIVKTQLLAFLMLTAKGVPFIYYGEEVGMPDLTFSSVKEMRDIQGTAAYYQALQTGTDEKQALEIAIEKTRDKARGPMIFPDGKPFTLGEPWIKMATLPEEEARMMWDFYQALLAFRKENDFKEMEYTFLKLDGEVLSYQRGEFIFLLHFGEEEITYPLQGNYQLVFGEAMMVENGIRMGAHTGIALRVEE

SEQ ID NO: 13391 - protein, 449 aa, Listeria monocytogenes EGD-e
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNNVDWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKGLQIEKSGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 13392 - protein, 488 aa, Listeria monocytogenes EGD-e
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 13393 - protein, 483 aa, Listeria monocytogenes EGD-e
MFENYQFPKDFLWGGAIAANQAEGAFKVDGKGISLADLHKYHKGKTNDEISEEQHKGVSLADIKASIEDKINYYPKRHGIDFYHTYPEDLELLAEMGFKTFRTSLDWTRIFPTGEETEPNEAGLKYYDQLIDKIIELGMEPIITILHYETPVEIVLNHGGWHNRKVIDLFEKYGKTVLDRYNKKVKYWIVINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFEENNIHIEITEEDKAILQKNTMDYLALSYYYSQMVDSKRNDLDPASITPNPHLKANPWGWAVDPKGLYNALSQYWDRYHKPIIIAENGFGMYDKLENGEIHDDYRIDYLSAHLKEMKRAMYGGVEIIAYCAWGPIDIVSCSSAQMEKRYGFIYVDLDNEGNGTGKRIKKDSFSWYKKVIESNGEDLEA

SEQ ID NO: 13394 - protein, 159 aa, Listeria monocytogenes EGD-e
MNVHDFSEKAMNGKEIALSDYKGKVLLIVNTASKCGLTPQLEGLEAMYKKLGGDNFEILGFPCNQFLRQDPGSDEEILEFCQMNYGVTFQMFSKIKVKGKDASPLYKYLTEQTGGKKVEWNFAKFLIDENGEVIERFPSKMKPEDFEDKVEALVAKVNN

SEQ ID NO: 13395 - protein, 286 aa, Listeria monocytogenes EGD-e
MEKIGFVGTGVMGSSMAGHLLEAGYEVLVYTRTKTKAEDLLDKGALWVETPGELANKVDILISMVGYPKDVEELYLGENGFLENLAVGTVAIDMTTSSPALAKKMAEFGREKGIGVLDAPVSGGDIGAKNGTLSIMVGGSEDVFLKVKPIFDILGSSVILQGDAGAGQHTKMVNQIAIASNMIGVTEAIIYAEAAGLNPSRVLDSISGGAAGSWSLANLIPRVLKDDFSPGFFIKHFIKDMGIAISEAKQMGLELPGLTLAEKMYQTLAEQGLSEEGTQALIKYYR

SEQ ID NO: 13396 - protein, 467 aa, Listeria monocytogenes EGD-e
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKSENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 13397 - protein, 496 aa, Listeria monocytogenes EGD-e
MTNLFQDDSLTLHTDLYQLNMMKAYFDDGLHERRSVFEVFFRDMPFDSGFVVFAGLERIIHYMQNLRFTETDIAYLHDELGFDGPFLEYLRNFKFKGNILAAKEGEFVFKTEPILQVEASLAEAQLIETALLNIVNFQTLIATKAARIRSVIDDETFAEFGTRRAQEMDAAIWGTRAAYIGGCDSTSNVRAGKIFGIPVSGTMAHAMVQAYRDELEAFRSYAKTHFDSIFLVDTYDTLKSGVPNAIKVAKEMGDKINFIGIRLDSGDMAFLSKKARQMLDEAGFTEAKIFASSDLDEHTILSLKAQKAKIDSWGVGTKLITAYDQPALGAVYKMAAIADENDILQDSIKLSSNTEKVSTPGKKKVYRIITNEDGLKAEGDYIALADESLENVDKLTMFHPVHTYIMKTVENFTARELLVPIFQNGELVYDMPSLDEIKAYKEENLALLWDEYKRTVRPEQYPVDLSVKCWKNKMRNIEKVRKSVQLHSPVELDMPF

SEQ ID NO: 13398 - protein, 234 aa, Listeria monocytogenes EGD-e
MSAYLAEFIGTMVLIMFGNGLLAGLTLNKSLSQGANWVVVTFGWGFAVMIGIYVAGAYSGAHLNPAVTIALAVGGSFPWADVVPYIIAQIAGAFVGASIVILHYYPHFKATPPEIDTHGIFSTGPAIRNTPFNLISEIIATFAFIFGLLMIGANSFTDGLNPLILGFLVVAIGMSFGPTTGYAINPARDLGPRLAYFLLPVPNKSGSDWRYAWIPIVGPIIGGLLAIGLFNILL

SEQ ID NO: 13399 - protein, 444 aa, Listeria monocytogenes EGD-e
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAVTACDSIQTFKLVVKTIARKHGLHATFMPKPLFGVNGSGMHFNMSLFNEKGNAFFDESGELELSQTAYHFLAGMLKHARGYTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIKAGLGEHIFEHFIEAKTIECDMFRTAVHPWEREQYLEIY

SEQ ID NO: 13400 - protein, 475 aa, Listeria monocytogenes EGD-e
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANYIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 13401 - protein, 472 aa, Listeria monocytogenes EGD-e
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKEERVYASTVLTGPSNYRFEGDKKAFVESVRRALYFSKIASYAQGFAQMRAASEEYNWDLQYGEIAKIFRAGCIIRARFLQKITDAYNQDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 13402 - protein, 446 aa, Listeria monocytogenes EGD-e
MAKFTYDVVIIGSGASGTTVAFEAQAAGLKVAIVEERNWGGTCVLRGCDPKKVLIGAREARNLSTRLRGKGIKQAATISWTDLMAFKETFVENVPESRLASFQEAGIETFFGAASFQDSHSLQVGDDLIYAEKIVIATGATPSTLKVEGKEYIQTSDDFLSLEKLPDSVVFIGGGYISFEFASIALAAGRDVHIIHHNSEPLKKFDPDFVAALVANIKDEGIHFHFDTDITKIENDGGKLHIKGKDSFSLQTDLIIGATGRMPNIAHLSLENASIDYTKKGIVVNEKLQTPNNPHIYACGDVAATKGAPLTPVVSLEAALVAKNVIGVNEKITYPAIPSVVFTSPKLASIGISTEEAKANPEKYQIKNHDTTSWYTYKRTNEQIALAKIIEDRESGQIKGAHFLSEEADYMINYIAILMKANLTLADLQSVIFAYPSPASDLTALN

SEQ ID NO: 13403 - protein, 377 aa, Listeria monocytogenes EGD-e
MAKRDYYEVLGISKSASADEIKKAYRKLSKQYHPDINKEAGADEKFKEISEAYEALSDPQKRAQYDQYGHVDPNQGFGGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 13404 - protein, 342 aa, Listeria monocytogenes EGD-e
MKNNVLVTGGTGFLGMHIIFQLLQQGYQVKTTVRSLKSKEKVIEILQNNGITDFTHLSFVELDLSKDEGWKEAMLDCEYVLSVASPVFFGKFKNEEELISPAIEGITRILQAAKEAKVKRVVMTSNFGAIGFSNADKNSITTEAYWTDELAKGLSAYEKSKLIAEKEAWKFMENETELEFATINPVAIFGPSQSNHVSGSFDLLKNLLNGSMKRVINIPLNVVDARDVADLHIRAMITPEANGERFIASADGEISMADIAHLLQRERPELVDKMPKKTLPNAAIRAAALFSKHAKEGELMINMNRQISNSKARDVLGWKPISTKEEAVLAAVDSLAKYGLLD

SEQ ID NO: 13405 - protein, 282 aa, Listeria monocytogenes EGD-e
MKIAYLGPAASFTHSAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKENAQDLELNQTRFFVLSRKPVSILLPKEEEKTSISVILPNNMPGALHKVLSTFAWRDIDLSKIESRPLKTSLGEYFFLIDVLSEGKEVLVTNALDEITLLGGTANKLGTYHVHRLQTN

SEQ ID NO: 13406 - protein, 272 aa, Listeria monocytogenes EGD-e
MIDTSLATQFLGEVIGTAILIILGAGVVAGVSLKRSKAENGGWVVITLAWGLGVTMGVYVSGYMSMAHLNPAVTIGMALAGAFPWNYVLPYILAQFIGAFIGATLIWLHYYPHWKQTEDKPTKLGVFATAPAIRHFTSNFFGEALGTFILVFGLLSLGANSFSDGLNPLVVGALIVAIGMSLGGTTGYAINPARDLGPRIAHFVWPISGKGGSDWGYSWVPVIGPIMGGALGALGYNAIINGELGMWFWVFAVLFVLILILTMQLDKKKDLA

SEQ ID NO: 13407 - protein, 429 aa, Listeria monocytogenes EGD-e
MQNYSKSEKAFKEAKKVLPGGVNSPVRAFNSVDASPVFMDHGKGAYITDVDGNEYIDYVLSWGPLILGHTDPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 13408 - protein, 294 aa, Listeria monocytogenes EGD-e
MLGDLFTKPKKRKYATIPSDGTKADVPEGIMTKCPECKKIMYTKELQKNLMVCNYCGFHHPIGAKARIDMLVDEGSFEEIDASLTTANPLGFEDYMDRIEKDKQKSGLNEAIVTGHATIGGNPLVIAVMDSRFRMASMGSVVGEKILRAVEDADKTNKPFVIFTASGGARMQEGMLSLMQMAKTSAAFKRFSNHGGLIITVMTHPTTGGVSASFASLGDYNFAEPGALIGFAGRRVIEQTVREELPEDFQTAEFLLKHGQLDDCISRLDLQNKLSFILSIHVKAPGVGGEVDGE

SEQ ID NO: 13409 - protein, 386 aa, Listeria monocytogenes EGD-e
MKHVFPTYKRFPIDLVNGTGTVVTDKNGKTYLDFTSGIAVCNLGHCPTNVAEAVQQQLGNIWHTSNLYECALQDSVAELIADGKERLVFFCNSGTESNEAALKLARKYTGKEKIITFEKSFHGRTFGSMSATGQAKIHQGFGELVPGFTYVPYNDIEAFRAEIDENTAAVMLEVIQAEGGVIPANAAFLLEVQLLCKKMGALLIIDEVQTGLGRTGTLYGFEQIGLDPDIFTLAKGLGNGLPIGAMVGKSDLISAFGPGSHGSTFGGNKLALAAAKEILLTMKQTGFLEEVNAKADYFRNLLEANLEVLDNVSDIRGGGFLIGIELENAAEPVITELRDKGLLILTAGTNVLRILPPLTVSYAEIDQAIYLLKSVLENQLIGSEEG

SEQ ID NO: 13410 - protein, 276 aa, Listeria monocytogenes EGD-e
MKKITPKAMCAWIPKREDETHKGDYGRVLIVAGNKQFGGAAIMAAEACVKSGAGLTTVASDSVNRPALQTRIPECMFIDYENITSLSEQISQFDTILIGPGLGLDAYAEEIFRLVLQKSTEHQQVIIDGDGITIYAKGENPHPAAKLTFTPHAGEWERLKVLAPDAVTPTDVALAIDATIVLKGHRTKVYSGESAWQNMYGTPAMATGGMGDTLAGTICGLMAQTEKPITGTLAAVFLHSYIGEILAKKRYVVLPTEIAEELPTYLKIFSETDEHA

SEQ ID NO: 13411 - protein, 257 aa, Listeria monocytogenes EGD-e
MTKTLTNKLAEKEHAAVVTYIMGGDGGLDNLEEQLLFLEKSGVSAIEIGIPFSDPVADGPIIQLAGLRALKEQVSLEAILNKLAMSKVQIPLIIMSYINPIFHLGIPKFVELVQKTPVKGLIIPDLPYEHQKLITPELQGTDIALIPLVSLTSPKERLEEIAKQAEGFIYAVTVNGTTGVRSEFDAHIDSHLAYLKSISPVPVLAGFGVSSIEHVEKFAHVCDGVIIGSKVVQMLHEEKTAELGAFLQKAAEVRIKN

SEQ ID NO: 13412 - protein, 469 aa, Listeria monocytogenes EGD-e
MDMTNWLQKRVRLSPKETALVFEGKEETFEEISEAVERLAGKLFALGIRKDEMIALLGKNDRMTFLLIHALQQLGAVTLFLNNRLTKKEIAYQLANAEVKQVIVADTFEDKVGAGISYSELAETDYKEPELLETWDLSRTASIMYTSGTTGKPKGVIQTYENHWWSAVASVLNLGLTEKDSWLCAVPIFHISGLSIMMRSVIYGIPVYLEEHFDEEKITQLLESGKVSTISVVTSMLERLLKIHGGSYHPNVRTILLGGGPASKTVLEICKQRDIPLVQSFGMTETASQIVTLPPKDALNKIGSSGKALFPAEVKIADDGEILLKGPSITPGYLHNKKATEASFVDGWFKTGDIGYLDEEGFLFVVERRSDLIISGGENIYPTEIEHVIGEYVAVKEVAVIGQPDDKWGSVPVAFIVAEETFDEDELQLICQTNLASYKIPKQIIIVEKLPKTASGKIQRNKLKERHSK

SEQ ID NO: 13413 - protein, 432 aa, Listeria monocytogenes EGD-e
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLDSFKEALAIWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDPVTNYAEAGATNGELFGRFFKGMLEEGINLAPSKYEAWFITSAHSEADILETIQAVDTVFGKMVQDN

SEQ ID NO: 13414 - protein, 489 aa, Listeria monocytogenes EGD-e
MGKATGFMEYDRIPSPGRDPKSRTRDWNEYSLPMPVADLTIQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAAGIHFAVPYLSQSTRDNLDNGGIQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 13415 - protein, 215 aa, Listeria monocytogenes EGD-e
MLEIKNLSKKFDQKTILDNVNITLQDGEILSIVGPSGGGKTTLLRCISGLEKMDAGEILIDGEKIDPMSRKDVENTIGVVFQEFHLFPHLSVLDNLILAPTLARKTKKADAVKEAERLLGLLDLADKANSMPYQLSGGQKQRVAIARALAMNPKVLLFDEPTSALDPDLRDHVAALILSLKKVGITQIIVTHDHTFAEKVADQMMEVEPLKKEAI

SEQ ID NO: 13416 - protein, 509 aa, Listeria monocytogenes EGD-e
MKRALISVSDKNGIVPFAEKLVELGVEIISTGGTKAAFEQAGVPVTGIEEVTEFPEMLDGRVKTLHPAIHGGLLARRDTAEHMEAIAAHNIKPIDLVIVNLYPFQETIQKPGVTLEEAIENIDIGGPSMLRSAAKNYAAVTVVVDTADYDAVLTELQEHGATTFETRQRLAAKVFRHTAAYDALIAEYLTNITGETFPEKVTFTYNRKQVLRYGENPHQDAAFYTEPGTIENSISAAKQLHGKELSYNNIRDADAALKIASEFTEPVAVAVKHMNPCGVGVGENIEEAYLKAYEADETSIFGGIVALNKEVDAKTAEHMSKIFLEIVIAPSFSEEAFAILAKKKNIRLLTVPFAGNMEGFEKTSVNGGLLIQANDSLVEDTTSYEVVTEKQPTDSEMKALLAQWKIVKHVKSNAIVVGSDKQTLGIGAGQMNRIGSALIALEQAGEKAKGAVLASDAFFPMDDTVEAAAKSGITAIIQPGGSIKDKESIAMADKYGISMVLTHVRHFKH

SEQ ID NO: 13417 - protein, 218 aa, Listeria monocytogenes EGD-e
MGKIAPSILSADFATLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKEIVDKKGLDIEIEVDGGVDHETAKLCRDAGANVFVAGSYIYGNKNRQTPIDKLRAIVGE

SEQ ID NO: 13418 - protein, 427 aa, Listeria monocytogenes EGD-e
MQKFFNKVFRLNEHKTNIRTEFLAGMIGFFTVAYIIVVNSSILAEAGVPYQGAVLATIFISAFGCLIMGFWANAPLILMPGMGINALFAYTLVQGMGLSWQVALAAVTMSGLLFMILAFTPLAGKLNEAIPLILKQAITVGLGLFLIFLGLEKGGIVTRGKHAIIAVGDLGDPFVLATLVTLLLTMILVIRKIPGAFLWSLIIGTIVGVMFGVAGKAGGASISVAPWSDVLFKADFSGIASVGFWSAVFTMTMVIVFETVGLTNGQVRQLKQTEKLPRILKASSLTAFLSGLFGTSPTISALESGSMFASGAKTGLATITTGLFFIASLFLMPVLSFIPNSAIAPILIIIGMSMLQEFKEMDLSNAAETFSALLIIVLIPLTYSIADGIAAGFIAYPILRAFTKNEERTSPVMYVIAALFLLQFIIQ

SEQ ID NO: 13419 - protein, 456 aa, Listeria monocytogenes EGD-e
MQQTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPMILTHMPVTAEVADIARHFLNGICIGIPAFFISAILRSFIDSLGLTRVTMLITLCTVPFNIFLNYCFIFGNFGFPEMGGAGSGYATGITYWLVVLVSVILIQTQTRLRKFGVFKGLTALRFSKIKEIIGIGVPNGLTILFETSIFSAVTILMGAFGTETIAAHQSANSVCTLLYAFPLSVASTLTILGGYETGAKRLKDAKQYRHIGMAAAILIGCVNGAILFFFRDIIAGFYTNDPALSNLIMHFLVYAILFQFADAVLSPVLGALRGYKDVTVTSIVAFISYWLIGLPVGYGLSFTNLGPFGYWIGLSTGLFVAAFILSIRVRKTEQKLSFNTKDAEISN

SEQ ID NO: 13420 - protein, 263 aa, Listeria monocytogenes EGD-e
MRVAVSGFKGRMGHEVVKTVLREADLELVAVLDHEPKEKNINEMVEFSSLDVPVFGNLSEMLEEIKPDCVVDFTTPKVGYSNTKTILEHGVRAVVGTTGFTPEQISELRTIAESKKIGALIAPNFAVGAVLMMQFAQKAAKYFPNVEIIELHHDNKLDAPSGTGVKTAEMMAETREFVKQGAADEVELIEGARGAEYEGMRIHSVRLPGLVAHQEVIFGAEGQGLTIRHDSYDRISFMSGVALSVRKTKELETLIYGLENILD

SEQ ID NO: 13421 - protein, 331 aa, Listeria monocytogenes EGD-e
MKYVKFGNTGMDVSKICLGTMGFGDKDKWIHKWVLDEANSRPIIKKALDLGINFFDTANIYSYGESEKIVGRALKDYANRDDIVLATKVQQTMRPDRPNSGGLSRKTILSEIDHSLKRLETDYVDLYIIHRFDENTPIEETMEALHDVVKSGKARYIGASAMYAWQFQKAQRVAERNGWTKFVSMQNHYNMIYREEEREMIPFCRDEKIAITPYSPLASGRLTRDLNETTDRSETDPVQKSKYDDMMNADKGIIERVAELAETHQVSRDKIALAWLLNKDEITSPIIGAQKESHLESAVEALNIKLTTSEVNYLEELYIPHPVVGALPTTK

SEQ ID NO: 13422 - protein, 347 aa, Listeria monocytogenes EGD-e
MKNTIKWIAIGFAGIILLPLLIVFFIYKKAVGKKDYNPEVLENLDKASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 13423 - protein, 229 aa, Listeria monocytogenes EGD-e
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNADLKPVNKYYLDK

SEQ ID NO: 13424 - protein, 241 aa, Listeria monocytogenes EGD-e
MINIKNLHKHFGKLEVLKGIDLEIASGEVVVVIGPSGSGKSTFLRCLNLLEQPTTGTILFENKDLMAKQTNVNELRQKMGMVFQNFNLFPHKNVLENLMLAPMKVKNEDSAAAKKHALSLLEKVGLADKATSYPSQLSGGQQQRVAIARALAMNPDVMLFDEPTSALDPEMVGEVLSVMKSLAKEGMTMVVVTHEMGFAREVADRVVFMDAGVIQEQGTPEEVFGNPQNDRTKDFLGKVLA

SEQ ID NO: 13425 - protein, 430 aa, Listeria monocytogenes EGD-e
MFQLKANGTDVKTEVISGFTTFLTMVYIVVVNPAILSAAGVPFNTVFMATIISAVIGTLWMAIFANYPIAIAPGLGMNAYFVTVVTTQKLDYSVAFAAVFVAGIIFLLLSLTPLREKIIEAIPHNLKAGITAGIGLFIAFLGFRMTGIIVSNDSNLVGLGDLHSKEAILAIVGLLITLILLALNVKGALFIGMIATGIIAFITGELKFTDGIVKLPPMPEFVFTNPIHAFGDVMSYGLYAVVLSFLLITIFDTTGTMIGVAKKAGLMKGESLPNAKQALMADAVATSVGSMFGTTPTSAYIESSAGVATGGRTGLTTLTVAILFMVSAFFAPLVGAVSGISAITAPALIVVGSMMIGAVKEIDWDTLDEAFPAFLVILAMPLTSSIAIGLAFGFISYPVLKVFTGKWRELNWFLIVIAVLFFILVAFLPH

SEQ ID NO: 13426 - protein, 259 aa, Listeria monocytogenes EGD-e
MITIKNIQKSFGENKVLKGIDLTVKKGEVVTILGPSGSGKTTFLRCLNLLERPENGEISMHDQIINCKKPSKKEVLQLRKNTAMVFQQYNLFSHKTVIQNVMEGLTVARKIPKKIAHEIAERELTKVGLADKLSAYPSQLSGGQKQRVGIARALAINPDVILFDEPTAALDPELVGEVLEVMLEIARAGATMIVVTHEMEFAKRVADQVVFMDGGLIVEQGTPDEVFNHTKEERTKRFLHRVSADYLYEIKEVKKERVI

SEQ ID NO: 13427 - protein, 450 aa, Listeria monocytogenes EGD-e
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLSDNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEDVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 13428 - protein, 226 aa, Listeria monocytogenes EGD-e
METLLSFEKVYKDYPSGPSIIHALKETNFEAKKGELIAIVGPSGSGKSTLLSLAGALLTPTGGTISINGKSVGNLSSKEQTALRLEEIGFIFQAAHLVPYLHVKDQISFIGKMAGKSAAELEKDTASLLSQLGISDRANFYPKDLSGGQKQRVAIARALINQPSVILADEPTASLDTERSREVVELIRNEVVQTSRTAIMVTHDERMLDLVNHVYRMEDGILTQES

SEQ ID NO: 13429 - protein, 510 aa, Listeria monocytogenes EGD-e
MSKSPVAIIILDGFGKRAETVGNAVAQANKPNFDRYWADFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 13430 - protein, 251 aa, Listeria monocytogenes EGD-e
MRKPIIAGNWKMNKTAAKAGQFAEDVKNNVPSSDAVESVVAAPALFLQELVRLTEGTDLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 13431 - protein, 396 aa, Listeria monocytogenes EGD-e
MAKKVVTDLDLKDKKVLVRVDFNVPMKDGKITNDNRIVAALPTIEYILEQNGKAILFSHLGKVKTEEDKEGKSLRPVAVRLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 13432 - protein, 338 aa, Listeria monocytogenes EGD-e
MSKLFSEYKLKDVTLKNRIVMSPMCMYSVENKDGIATDFHFAHYVSRAAGGTGLVILEATAVQEVGRISEFDLGLWNDEQVPALKKLVGGLHYHGAKAGIQLAHAGRKAVLPGEIVAPSAIAFDEKSDKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEAPKQYSRAWK

SEQ ID NO: 13433 - protein, 222 aa, Listeria monocytogenes EGD-e
MTLMMKNITKNYQDGEQVIEVLKNVSLEVAQGEFVAIVGPSGAGKSTFLSIAGALLSPTEGEIAIGGKVLNDLTSKDLTKVRLDKVGFIFQGANLIPYLNVRDQLLVIAELSGDKGRVAKEKADELLKELGLTARENNYPESLSGGEKQRVAIARALMNDPDIILADEPTASLDASRGHKVVQMIADEVKRKNKAAIMVTHDERVLDLVDRVIRIEDGYLKD

SEQ ID NO: 13434 - protein, 215 aa, Listeria monocytogenes EGD-e
MKLVLMGLPGAGKGTQAEQIVEKYNIPHISTGDMFRAAMKNNTELGRKAKSFMDNGDLVPDEVTNGIVRERLSEDDAKDGFLLDGFPRTVEQAQELENILSDLGTELDAVINIDVEKDVLMKRLTGRWICRTCGKTYHEIYNPPKVPGKCDLDGGELYQRDDDKKETVEKRLNVNMKQTKPLLDFYSEKGKLHNINGEQEIKDVFVDVEKILASF

SEQ ID NO: 13435 - protein, 214 aa, Listeria monocytogenes EGD-e
MTFVAPSLLAADYMNMANSIKEAEDAGADYLHIDVMDGHFVPNLTFGIDMVEQIGKTATIPLDVHLMLSNPENYIEKFAAAGAHIISVHIEAAPHIHRVIQQIKAAGCKAGVVLNPGTPASVLDAVLADVDLVLQMTVNPGFGGQAFIDSTIKNMRYLDNWRRKNHGSYVIEVDGGVNAETAEKCKQAGVDILVAGSYFFGATDKAACIQGLKK

SEQ ID NO: 13436 - protein, 224 aa, Listeria monocytogenes EGD-e
MRKIAASIMCADQLHLGDELQRLESAGVELLHCDVMDGVYVNNLALGPEYLEIVRNNTEIPLDIHLATITPLKYIDMFGPVKPEYISFHVEVAEDVSEIIRKIRSYNVKPSIAINPETPIEAIYPYLDDVEMVLMMTVNPGFAGQKFQTDVLQKLHDLKAKLAGKIHAPLIEVDGNINKETVGLMRDCLPDIYVLGTSALFHDRDKTSYAERLVHIWSNVEKHV

SEQ ID NO: 13437 - protein, 343 aa, Listeria monocytogenes EGD-e
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKIDTDKMITKVYGLDDWREAFEAVMAGNEIKVLVKS

SEQ ID NO: 13438 - protein, 484 aa, Listeria monocytogenes EGD-e
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 13439 - protein, 482 aa, Listeria monocytogenes EGD-e
MSNTKFPDGFMWGGATAANQFEGGYNLGGKGLACADLFTGGTHTEPRRITAQLEESTFYPSHEAVDFYHHYKEDIKLMAEAGFKVFRMSINWTRIFPTGKEAEPNEEGLQFYEDVFNELKKHQIEPLVTIAHFDIPLALTNEVNGWASRDLIDYYLHFCEVIFKRYKHLVKHWLTFNEINTATMEIGNYLSLGIRHAEGDFLHQKDDPKVRYQALHHQFVASAKAVKLGHSINPDFMIGCMIAYMPRYPRTCEPSDVLLAKQTEAMHSHFCGDVHVKGYYPFYAKTFFKDNGIELEFDPEDEQILREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVDKYDDGTGDYSRKKKASYYWYKDVISSNGEIGLEE

SEQ ID NO: 13440 - protein, 507 aa, Hordeum vulgare subsp. vulgare
MEVEAGAHGDTAASKFTLPVDSEHKAKSFRLFSFANPHMRTFHLSWISFFTCFISTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYFDHFHLDLRAAGTIAACFGMANIVARPTGGYLSDLGARYFGMRARLWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKAKGLHIAGQKFAENSRSERGRRNVILATSATPPNNTPQHV

SEQ ID NO: 13441 - protein, 509 aa, Hordeum vulgare subsp. vulgare
MEVESSSHGAGDEAASKFSLPVDSEHKAKSIRLFSFANPHMRTFHLSWISFFTCFVSTFAAAPLVPIIRDNLNLAKADIGNAGVASVSGSIFSRLAMGAICDLLGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGMMHVVMGLLVLTMGQDLPDGNLASLQKKGEMAKDKFSKVVWGAVTNYRTWIFVLLYGYCMGVELTTDNVIAEYYFDHFHLDLRTSGTIAACFGMANIVARPAGGYLSDLGARYFGMRARLWNIWILQTAGGAFCLWLGRAKALPESITAMVLFSICAQAACGAVFGVIPFVSRRSLGIISGLSGAGGNFGAGLTQLLFFTSSKYGTGRGLEYMGIMIMACTLPVALVHFPQWGSMLLPPNANATEEEFYAAEWSEEEKKKGLHIPGQKFAENSRSERGRRNVILATAATPPNNTPQHA

SEQ ID NO: 13442 - protein, 475 aa, Fuchsia cyrtandroides
  misc_feature (301)..(301): Xaa can be any naturally occurring amino acid
  misc_feature (375)..(375): Xaa can be any naturally occurring amino acid
MSPQTETKAGVGFKAGVKDYKLTYYTPEYETKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVXDRQKNHGIHFRVLAKALRMSGGDHIHAGTVVGKLEGEREITLGFVDLLRDDFVEKDRSRGIYFTQDWVSLPGVXPVASGGIHVWHMPALTEIFGDDSVLQFGGGTLGHPWGNAPGAVANRVALEACVQARNEGRDLAREGNEIIREACKWSPELAAACEVWKEIKFEFQAMDTL

SEQ ID NO: 13443 - protein, 475 aa, Hauya elegans
  misc_feature (309)..(309): Xaa can be any naturally occurring amino acid
  misc_feature (328)..(328): Xaa can be any naturally occurring amino acid
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGXHFRVLAKALRLSGGDHIHXGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 13444 - protein, 475 aa, Ludwigia peruviana
  misc_feature (131)..(131): Xaa can be any naturally occurring amino acid
MSPQTETKASVGFKAGVKDYRLTYYTPEYETKDTDILAAFRVTPQPGVPAEEAGAAVAAESSTGTWTTVWTDGLTSLDRYKGRCYHIEPVAGEENQYICYVAYPLDLFEEGSVTNMFTSIVGNVFGFKALXALRLEDLRIPPSYTKTFQGPPHGIQVERDKLNKYGRPLLGCTIKPKLGLSAKNYGRACYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRISGGDHIHSGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREACKWSPELAAACEVWKEIKFEFAAVDTL

SEQ ID NO: 13445 - protein, 475 aa, Ludwigia peploides
  misc_feature (131)..(131): Xaa can be any naturally occurring amino acid
MSPQTETKASVGFKAGVKDYRLTYYTPEYETKDSDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALXALRLEDLRIPPSYTKTFQGPPHGIQVERDKLNKYGRPLLGCTIKPKLGLSAKNYGRACYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 13446 - protein, 379 aa, Zea mays
MATAGKVIKCKAAVAWEAGKPLSIEEVEVAPPQAMEVRVKILFTSLCHTDVDFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 13447 - protein, 511 aa, Nepeta racemosa
ILIALLCTLPFLFFLKKWRRSYSGKTPPPSPPKLPVLGNLHQLGTFPHRSLQSLSRRYGPVMQLHFGSVPVLVASSPEAAREIMKNQDLNFSNRPNLSIPRRLLYDNHDVAFAPYGEYWRQIRSICVLQLLSNKRVQSFRRVREEETSIMVEKIMQLQKTTPTAAVNLTDLLTCLTNDVFCRIALGKKYGGTTTGDGEYHVRSLKKNLAEFYVLLGISPLWEYIPWLEWTRRFDGVDRRIEEVSRTFDEFLGKVIQEHRVRDKREDTTVVGDTVGLDFVDLLLQFQRENERSSSPVDDLTIKAVILDMFLAGTDTTVTALEWALSELIKNPRAMKILQKEVRGVAGSKGEIEESDLEKMPYLKAVMKESLRLHAPVPLLVPRESTRDTKVLGYDVASGTRVLINCWAIGRDSSVWEESETFLPERFLETSIDYRGMHFELIPFGSGRRGCPGATFAAAIDELALATLVHKFDFKLPNGVRVEDLDMSEGSGFTIHKKFPLLVVPTPHACTS

SEQ ID NO: 13448 - protein, 160 aa, Lycopersicon esculentum
MADFMEKAMDFVSDKVEKPEADITDFDLKKVSMDSISYHAKVAVKNPYSVPVPIMQISYTLKCSGRVIVSGTIPDPGNIKANDTTILDVPVKVPHSMLVSLGKDIGKDWDIDYKLELGLAIDLPVIGDFTIPLSHSGEIKLPSLSDLWNGDKQEDTEKEI

SEQ ID NO: 13449 - protein, 411 aa, Pseudomonas sp. JR1
MIKSIVIIGAGLAGATATRYLRAQGYQGKIHLVGEELHVAYDRPSLSKVALSGKVVEPPAILDPCWYASADIDLHLGVRVTGIDVVNHQVLFESGDILAYDRLLLATGARARRMAITGSELAGIHTLRDRADSQALRQALEPGQSLVIVGGGLIGCEVATTAINAGAHVTVLEAGDELLLRVLGRSTGAWCRNELERLGVRVELNAQAAHFEGEGHVHAVVCADGRRIAAGTVLVSIGVEPADELARAAGFACERGVVVDATGASSCPAVFAAGDVAAWPLRSGELRSLETYLNSHMQAETAAAAMLGKSIPALQVPTSWTEIAGHRIQMVGDIEGPGEVVLRGNVENGQPLVQFRVLDGRVEAATAINAPKDFSVATRLVADHIPVSATKLQDASSNLRDFMKAKAERCE

SEQ ID NO: 13450 - protein, 278 aa, Streptococcus thermophilus
MKVDDDLVRQVIRPRLRGSHKGSYGRVLLVGGLYPYGGAIIMAAIACVNSGAGLVTVATDRENIIALHAHLPEAMAFDLRETERFLDKLRAADVILIGSGLGEEETADWALELVLANIRSNQNLVVDGSALNLLAKKNQSSLPKCHLILTPHQKEWERLSGLAISEQSVSNTQRALEEFQSGTILVAKSHKTAVYQGAEVTHLEVGGPYQATGGMGDTLAGMVAGFLAQFASTDSYKAVIVATWLHSAIADNIAENAYVVLPTRISKAIPSWMKKLSL

SEQ ID NO: 13451 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 13452 - protein, 197 aa, Davidia involucrata
MVVMETWLLNCYHRYKEDVKILKKMGLNAYRFSISWSRVLPCGRLSGGVNKEGINYYNNLIDELLHNGIEPYVTLFHWDLPQALEDEYGGFLSPRIVEDFCNYVELCFWEFGDRVKHWITFNEPWSYSVAGYVNGVFPPGRGATSPEPVRRSNIKTISALHRSSGNQGLRMIINSGDPGTEPYIVSHYQLLAHAAAV

SEQ ID NO: 13453 - protein, 348 aa, Pisum sativum
SYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 13454 - protein, 146 aa, Oryza sativa
MKGYFRQPEATRATLTEDGWLNTGDIAKLDHDDQLYIVGRSKELIIRSGFNIYPPDVEAVINEHPAVTLTAVVGRQIAGNEEVVAFVQCEPGVEVDMAELKAFIAERLAPYKRPTQIVLMDTLPSTASGKILKGRLRDLAQQESAS

SEQ ID NO: 13455 - protein, 136 aa, Pisum sativum
NTDITSNGERVKCMQVWPPIGKKKFETLSYLPPLTRDQLLKEVEYLLRKGWVPCLEFELLKGFVYGEHNKSPRYYDGRYWTMWKLPMFGTTDPAQVVKEVDEVVAAYPEAFVRVIGFNNVRQVQCISFIAHTPESY

SEQ ID NO: 13456 - protein, 320 aa, Petunia x hybrida
MENFPIISLDKVNGVERAATMEMIKDACENWGFFELVNHGIPREVMDTVEKMTKGHYKKCMEQRFKELVASKALEGVQAEVTDMDWESTFFLKHLPISNISEVPDLDEEYREVMRDFAKRLEKLAEELLDLLCENLGLEKGYLKNAFYGSKGPNFGTKVSNLPPCPKPDLIKGLRAHTDAGGIILLFQDVKVSGLQLLKDGQWIDVPPMRHSIVVNLGDQLEVITNGKYKSVMHRVIAQKDGARMSLASFYNPGSDAVIYPAPALVEKEEAEKNKQVYPKFVFDDYMKLYAGLKFQAKEPRFEAMKAMETDVKMDPIATV

SEQ ID NO: 13457 - protein, 139 aa, Retama raetam
LLFHGELYLAAGGEKVFKILGPGIFGSSAFDILGALPESLILLVTGLNSDKESAQEYASSGVGLLAGSSILLLTVVWGTCAIIGSQKLKDDPKSSLKESLTDSGLTMDIETVKMSRIMVFSVIPLLIMQTPTLFKLSST

SEQ ID NO: 13458 - protein, 1505 aa, Neurospora crassa
MAPNPPGSFSTERSYHGGNGKAAAVVATKVPGTPRREAGGHGREKAVQDPGLKDYRLGDCIGKGAFGSVYKAFNWGTGEAVAVKQIKLVDVPKSELRMIEAEIDLLKNLHYIGFVKTADCLNIILEYCENGSLHSICKAYGKFPENLVGVYMTQVLQGLQYLHDQGVIHRDIKGANILTTKDGTVKLADFGVSTSTLAGPDKEAQVVGTPYWMAPEIIQLSGATSASDIWSVGCTVIELLQGKPPYHHLAAMPALFAIVNDDHPPLPEGVSPAARDFLMQCFQKDPNLRVSAKKLLRHSWIQGCRRSDAPISKAPSNFIQAVEEVKQWNKALKSSEATPRTSIGSDHGNPSTQNRNASGQHRPNLSISTKVPPQQAKPKANAEVFRSPAVEADDDNWDNDFATAISPSALHLPHIKGQDNFGGLLSSDRLKAFASIDSSREDTENWDEDFGGEFEQTIRPLPKRSDRVSDSKSSQQGHRRQRSSKTTISSASQTKSPVRTQFGNKFELPPRPESIYREQSTEDYSDLFGDTDSVFSSRLNVAVKDAPQLFHPSDLTSLPRSTASPVNGSSGRRQSASARSPSAPEKPAVRRTRMTVEITKFAEDEGDEDFSDIFGAEPESFTKPPKSDEGSEDGHQLMLLSKLSNNSWLGDDEDEDDPFAMMDPGWDEMDLEANIARDRHARLAEKVEERVKSLKPTESEDILADLAEDLLNLLWENSEVKDLIISAHGLLPILEILEPCTVKSRQHMILQLLKIVNAIILDDVELQENLCFVGGIPIITKFAARQYSNEIRLEAAAFVRQMYQTSTLTLQMFVSAGGLNVLVEFLDEDYDMSPDLVLIGVNGIWNVFELQGPTPKNDFCRIFSRSKILDPLAAVLHKVLDEDDRDELSELIEARIVNIFYLFSQAENYVKEVVAERFVLKTVLKDLRRMTPAHQITMLKFIKNLSMLSTTLESLHSADAIDYLIDVLSNSMKRGQQHFREISNQVLNTMFNLCRLSKERQEYAASNGIIPLLLKIMKTDRPPKEFVLPILCDMAHSGSKGRRYLWQNNGLEFYVSLLADQYWQVTALDAIFVWLEKETAKVEHHLLDGNFTTAITSCFNTNKANAFDANLLEPLLKLVRLSPSVAASLAKVEMYAGIAQKLSHKKAVVRLNLLRLVRSIMDGCEVNNTPMATLATSTAGRALRVLFDDIQILADKDPAVLVRNLASEIVRSHIDIDLQHDVAALGALNMGAGPSAIPNPLNNLSSGPRSRSGPRRNTSYTPPGLHASMSMPPTPTHGHRASHSSSAAYIEVASTPKRSGISLAQEREAMYRPHSRDGGVPLINIPRRVSQDTSAGIPSLSSSMGSAGGLGTPSRMRLPRMSMTQYSSPRPSLSSAATAPGAVSATGMGIGNSSIASSRAERERERSESSLSNHNKENYGRIRSGSSVAGPEARILGGGGLYSVSPTGSAVSLSSSFQGSGGGGSEGFSRSYGARESSFSVMGGSAGAGNAKRRSRAPSSDMRWS

SEQ ID NO: 13459 - protein, 481 aa, Neurospora crassa
MGSMYQVQSKLRQDLGLHKVQAVRKPGRELNGTKAYVSAMARYGFNPTEESRFFHLKKTDLTKEFQRRGYIRHWEQLVRTPQERPDDPHTDNEPVPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQEDIPKEAELFTSAFYSARDDKSEEKSFYTFGWVDEDLVKASGKDITWTPIDNSEGFWKFPSESATVDGDNVSVSGNTAIADTGTTLALVSDTVCKALYAKIPGSKYSYRYQGYLIPSTITADQLPQLSVAVGGEQFVIQNEDLLLAPADDDHWYGGVQSRGTMPFDILGDTFLKSIYAIWDQGNNRFGAVPKIEVNQHTVFPDTEPSPEASSPEPADKVGDVSPVEQVKGAVKSLKVL

SEQ ID NO: 13460 - protein, 278 aa, Neurospora crassa
MGFIDDEVKRLGDVIASLEDRVRSLETRDFSGKPVTTAEQLRMVLMGPPGAGKGTQAPKIKEKFNCCHLATGDMLRAQVAKGTALGKQAKKIMNEGGLVSDDIVIGMIKDELENNKECQGGFILDGFPRTVPQAEGLDAMLRERNLPLQHAVELKIDDSLLVARITGRLVHPASGRSYHRIFNPPKDDMKDDITGEPLVQRSDDNAEALRKRLETYHKQTAPVVGYYQNTGIWKAIDASQEPAQVWKSLLAIFEGDKAKASSAGSGIMSKIASAAKSS

SEQ ID NO: 13461 - protein, 323 aa, Neurospora crassa
MGFERGGRGGARGGGRGGFGGDRGGRGGARGGSRGGFGGGRGGGAPRGRGGPRGGGRGGATRGRGGARGGAKGGAAGKKVIVEPHRHKGVFVARGGKEDLLATVNLVPGESVYGEKRISVENASKEEGGASTKTEYRIWNPFRSKLAAGILGGLETIYMKPGSKVLYLGAASGTSVSHVADIVGPTGSVYAVEFSHRSGRDLINMATRRTNVIPIVEDARKPMAYRMLLPMVDVIFADVAQPDQARIVGINAKLFLKQGGGLLISIKASCIDSTAPPEQVFASEVQKLREDKFFPKEQLTLEPYERDHAMVSCVYQQKEFVDN

SEQ ID NO: 13462 - protein, 392 aa, Neurospora crassa
MLRPTFIASCLAAVAAAHGDHDQKVVAGPHQGLWYNTLPGDGGTQADSVFSGISTFGRLPYLPCLASKDINYDIAFIGAPFDTGTSYRPGARFGPSGIRQGSRRLNLYGGYNVPLATNPFNSWATIIDCGDIPVTSYDNTFALSQIERGHHSILSRKPTTDSALPGPSLQGKTLPRVITLGGDHTITLPLLRSINRSYGPVSVIHFDSHLDSWRPKVFGGSPSEVASVNHGTYFYHAAQEGLLRNDSNIHAGIRTTLSGPSGYENDGYCGFEIVEAREIDTIGTEGIIKKIRERVGTEKPVYLSLDIDTLDPAFAPATGTPETGGWSTRELRTILRGLEGINIIAADIVEVAPAYDTNAEHTTMAAADALYEIMSIMVKRGPLSLVSEPHDL

SEQ ID NO: 13463 - protein, 430 aa, Neurospora crassa
MVFGRSLTESRLISSANYVRTELPTRIAHRIRDMQRLPYVVVTNPHMNEVYDLYYSAFDTFRKVPEIKTLEDNDALCATIRSNLKAHLTVIPKLAMGILESAGLMDAKELDKFMNTILRSRISRRVIAEQHLALTDTFHAPWFSPGAKLSESEFIGEVFLKCVAKDVVERCGQAIRDIAQHAYGPDVAIPEIKIDGHLEANFPYILSHLEYIIGELLRNSVQAVVEKHQRYKEKVAAAGGKTDEIGPPPAIEVTICESQQHVIIRISDQGGGIQQDVLPYLWSFSKGPASQQLLTNLEQVPKMAATMQELKVEGSTSSEAGTTVGKLQQQRQEQQQQQQQQQKQQIKGIHNGNNFPGDPGYCNSLATLTSRPPNLRLGMGLPLSRVYAEYWAGSLALHSLEGYGVDAFLQISKLGNKNEQLTTRATMDAV

SEQ ID NO: 13464 - protein, 294 aa, Neurospora crassa
MSILQIPYREGRDGFWGEQTSTLNWCEEDYNITYYCAELVNTLTNLMFMWLGVKGLRNVLEFKHSPIFILAYVGYLVVGLGSMAFHATLKYEMQLADELPMIYTVFIMCYATFSYKRSPRTQLLIASIMVGLGIFITVYYLYAKNPVFHQVAFALITATTIFRGFYVMEYQLRPQLRERNPTACSRIMREMWTLALVSIITFVGGFFIWNMDNIFCRHLTTAKNQLQLPWSIVLEGHGWWHILTGLGAYEMILWRIWLVRCLSGEEEKFMLDWRPWRSIPQVVPRTHKGATKSS

SEQ ID NO: 13465 - protein, 339 aa, Yarrowia lipolytica
MDVDSDIAAESVARVYADVNNLMPPSYWDYDKLALKWGQQDNYEIIKKIGRGKYSEVFEGINIVSKELVVIKALKPVKRKKIKREVKILQNVAGGPNIISLLETVRDPQSKMPAFIFEHVQNLDFRALYPKFTDYDIRYYMYELLKAIDYSHSKGIMHRDVKPHNVMIDHEKRKLRLIDWGLAELYHAGTEYNVRVASRYFKGPELLVDFQLYDYSLDLWSYGAMFASMIFKKEPFFHGTSNTDQLVKIARVLGTEKLWDYLEKYNIELGAEYDDIGTYPARPWSKFVNVDNEAYISQEAIHLLDNLLRYDHQERLTAKEAMAHDYFKPVRVREEGEQE

SEQ ID NO: 13466 - protein, 309 aa, Bacillus thuringiensis serovar kurstaki
ACNSVRELLTVHESLVGESIKRWGTEEQKRKWLPEMAKGNLLFSFALTEPEVGSDAKAVGTSYKQVNDHFILNGHKKWISFADIADCFLVFASSEGKVSAFIVERSMTGVSTNKMSKLLASNSSHIAEIHLQDVKVPAENLLGPIGGGWSYVVNTALDHGRYSIAWAGVAIAQEALEAMVAYSRRRKQGNKYICEYEAIQTILAEASVNIKAARSLCQEAGKKRQDRHTDAVIETTIAKYFASKMAMKVATNAVQVFGGNGFSREYPVERLFREAKVLEIIEGTSQVLQPIIAQHALHTCSQKGGLLRI

SEQ ID NO: 13467 - protein, 371 aa, Forsythia x intermedia
METDALPLPATTVCVTGASGFIGSWLVMRLLERGYFVRATARDPENKQKVKHLLELPRADTNLTLWKADMTVEGSFDEAIQGCEGVFHVATPMDFESKDPENEVIKPTIEGFLSLIRSCTKAKTVKRIVFTSSAGTVNVEEHQKSVYDETDYSDLNFIYSKKMTGWMYFASKILAEKVAWEAAKENSIGFISIIPTLVVGPFIMPTFPPSLITALSPITGNEAHYSIIDQCQYVHLDDLCEAHIFLYEYPNAEGRYICSSHDATIYDVAKMIRDKWPKYDIPTEFEGIGKDIPVVSFSSKKLIGMGFTFKYTLEDMYRGAIETCREKGLLPYSTRNQANREKKELLLNLKKFHGHDQEELPANGKEKHTNG

SEQ ID NO: 13468 - protein, 466 aa, Ampelopsis brevipedunculata
SVGFKAGVKDYKLTYYTPQYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVCARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACELWKEIKFEFEAMDTL

SEQ ID NO: 13469 - protein, 207 aa, Gossypium hirsutum
MEKSEKGNGVAPATRSPMALMGSSRNENQEVNTSMRTAETMLRLVPMALGVAALVVMLKNSQSNDFGSVSYSDLGAFRYLVHANGICAGYSLLSAIIAAVPSPSTMPRAWTFFLLDQILTYVILGAAAVSTEVLYLANKGDSAITWSAACGTFAGFCHKATIAVVITFVAVICYAVLSLVSSYRLFTKFDAPVNYPSKTIEATVFHG

SEQ ID NO: 13470 - protein, 466 aa, Cissus quadrangularis
SVGFKAGVKDYKLTYYTPDYETKPTDILAAFRVTPQPGVPPEEAGAAVAAESSTGTWTTVWTDGLTSLDRYKGRCYNIEPVVGEENQYIAYVAYPLDLFEEGSVTNMFTSIVGNVFGFKALRALRLEDLRIPVAYIKTFQGPPHGIQVERDKLNKYGRPLLGCTIKPKLGLSAKNYGRAVYECLRGGLDFTKDDENVNSQPFMRWRDRFLFCAEALFKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGLYFPQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEALDTL

SEQ ID NO: 13471 - protein, 466 aa, Rhoicissus rhomboidea
SVGFKAGVKDYKLTYYTPEYETKPTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPVAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRALCARELGVPIVMHDYLTGGFTANTTLAHYCRDNGLLLHIHRAMHAVIDRQKNHGIHFRVLAKALRMSGGDHIHAGTVVGKLEGERGITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEAMDTL

SEQ ID NO: 13472 - protein, 468 aa, Rhoicissus digitata
KASVGFKAGVKDYKLTYYTPEYETKPTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPVAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAACAKELGVPIVMHDYLTGGFTANTTLAHYCRDNGLLLHIHRAMHAVIDRQKNHGMHFRVLAKALRMSGGDHIHAGTVVGKLEGERGITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEAMDTL

SEQ ID NO: 13473 - protein, 468 aa, Rhoicissus tomentosa
KASVGFKAGVKDYKLTYYTPEYETKPTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPVAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAACSRELGVPIVMHDYLTGGFTANTTLAHYCRDNGLLLHIHRAMHAVIDRQKNHGMHFRVLAKALRMSGGDHIHAGTVVGKLEGERGITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEAMDTL

SEQ ID NO: 13474 - protein, 393 aa, Rhizopus microsporus var. chinensis
TFTLNSSCIAIAALAVDAVNAAPGEKKISIPLAKNPNYKPSAKNAIQKAIAKYNKHKINTSTGGIVPDAGVGTVPMTDYGNDIEYYGQVTIGTPGKKFNLDFDTGSSDLWIASTLCTNCGSRQTKYDPKQSSTYQADGRTWSISYGDGSSASGILAKDNVNLGGLLIKGQTIELAKREAASFANGPNDGLLGLGFDTITTVRGVKTPMDNLISQGLISRPIFGVYLGKASNGGGGEYIFGGYDSTKFKGSLTTVPIDNSRGWWGITVDRATVGTSTVASSFDGILDTGTTLLILPNNVAASVARAYGASDNGDGTYTISCDTSRFKPLVFSINGASFQVSPDSLVFEEYQGQCIAGFGYGNFDFAIIGDTFLKNNYVVFNQGVPEVQIAPVAQ

SEQ ID NO: 13475 - protein, 202 aa, Arabidopsis thaliana
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKCDLTSQKVVSTETAKAFADELGIPFLETSAKNATNVEEAFMAMTAAIKTRMASQPAGGSKPPTVQIRGQPVNQQSGCASS

SEQ ID NO: 13476 - protein, 248 aa, Lycopersicon esculentum
TGVISGALLYIRDDFKSVGKRTWLQETIVSMAVAGAIFGAAFGGWFNDKYGRRKSILLADILFFIGAIVMAVAPAPWVIIIGRVLVGLGVGMASMTSPLYISEASPARIRGALVSTNGLLITGGQFLSYLINLAFTRTKGTWRWMLGVASIPALVQFILMLSLPESPRWLYRADKKDEARAILEKIYPAHEVEDEMKALQTSIEVEKADKEFLGDGVFSKVKSAWSNTIVRRGLYAGITVQVAQQFVG

SEQ ID NO: 13477 - protein, 475 aa, Chlamydomonas reinhardtii
  misc_feature (104)..(104): Xaa can be any naturally occurring amino acid
  misc_feature (151)..(151): Xaa can be any naturally occurring amino acid
  misc_feature (201)..(201): Xaa can be any naturally occurring amino acid
  misc_feature (256)..(256): Xaa can be any naturally occurring amino acid
  misc_feature (369)..(369): Xaa can be any naturally occurring amino acid
MVPQTETKAGAGFKAGVKDYRLTYYTPDYVVRDTDILAAFRMTPQPGVPPEECGAAVAAESSTGTWTTVWTDGLTSLDRYKGRCYDIEPVPGEDNQYIAYVAYXIDLFEEGSVTNMFTSIVGNVFGFKALRALRLEDLRIPPAYVKTFVGXPHGIQVERDKLNKYGRGLLGCTIKPKLGLSAKNYGRAVYECLRGGLDFTXDDENVNSQPFMRWRDRFLFVAEAIYKAQAETGEVKGHYLNATAGTCEEMMKRAVXAKELGVPIIMHDYLTGGFTANTSLAIYCRDNGLLLHIHRAMHAVIDRQRNHGIHFRVLAKALRMSGGDHLHSGTVVGKLEGEREVTLGFVDLMRDDYVEKDRSRGIYFTQDWXSMPGVMPVASGGIHVWHMPALVEIFGDDACLQFGGGTLGHPWGNAPGAAANRVALEACTQARNEGRDLAREGGDVIRSACKWSPELAAACEVWKEIKFEFDTIDKL

SEQ ID NO: 13478 - protein, 431 aa, Escherichia coli
SKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 13479 - protein, 370 aa, Oryza sativa
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGRVSAAS

SEQ ID NO: 13480 - protein, 488 aa, Oryza sativa (japonica cultivar-group)
MAGNLLANYVQVNVMLPLDVVTVDNKFEKVDETRAQLKKLTEAGVDGVMVDVWWGLVEGKGPGSYDWEAYKQLFRLVQEAGLKLQAIMSFHQCGGNVGDIVNIPIPQWVRIVGSDDPDIFYTNRGGARNIEYLTLGVDDQPLFHGRTAIQMYADYMKSFRENMAEFLDTGVIVDIEVGLGPAGEMRYPSYPESQGWVFPGIGEFICYDKYLEADFKAEAAKAGHPEWELPDDAGEYNDTPEKTRFFADNGTYVTEKGKFFLTWYSNKLIKHGDKILDEANKVFLGCRVQLAIKISGIHWWYRVPNHAAELTAGYYNLDNRDGYRTIARMLTRHRACVNFTCAEMRDSEQSSEAKSAPEELVQQVLSAGWREGLHVACENALGRYDATAYNTILRNSRPHGINKNGPPEHKLFGFTYLRLSDELLEGQNYSTFKTFVKRMHANLVSATNVDPLEPLQRSMPEMPIGKILQAAHPKLAPFPFDENTDMPV

SEQ ID NO: 13481 - protein, 488 aa, Oryza sativa (japonica cultivar-group)
MAGNLLANYVQVNVMLPLDVVTVHNKFEKVDETRAQLKKLTEAGVDGIMVDVWWGLVEGKGPGSYDWEAYKQLFRLVQEAGLKLQAIMSFHQCGGNVGDIVNIPIPQWVRVVGVNDPDIFYTNRGGARNIEYLTLGVDDQPLFHGRTAIQMYVDYMKSFRENMAEFLDAGVIVDIEVGLGPAGEMRYPSYPQSQGWVFPGIGEFICYDKYLEADFKAEAAKAGHPEWELPDDAGEYNDTPEKTRFFTDNGTYVTEKGKFFLTWYSNKLIKHGDKILDEANKVFLGCRVQLAIKISGIHWWYRVPNHAAELTAGYYNLDNRDGYRTIARMLTRHRACVNFTCAEMRDSEQSSEAKSAPEELVQQVLSAGWREGLHVACENALGRYDATAYNTILRNSRPHGINKNGPPEYKLFGFTYLRLSDELLEGQNYSTFKTFVKRMHANLVSATNVDPLEPLQRSMPEMPIGKILQAAHPKLAPFPFDENTDLPV

SEQ ID NO: 13482 - protein, 284 aa, Nicotiana tabacum
MSKDVIEEGQVHQQHGKDYVDPPPAPLLDFAELKLWSFHRALIAEFIATLLFLYVTVATVIGHKKLNGADKCDGVGILGISWAFGGMIFVLVYCTAGISGGHINPAVTFGLFLARKVSLLRAVGYIIAQSLGAICGVGLVKGFMKHYYNTLGGGANFVQPGYNKGTALGAEIIGTFVLVYTVFSATDPKRSARDSHVPVLAPLPIGFAVFMVHLATIPITGTGINPARTFGAAVIYNTEKIWDDQWIFWVGPFVGALVAAVYHQYILRGSAIKALGSFRSNPTN

SEQ ID NO: 13483 - protein, 287 aa, Medicago truncatula
MGKDVEGQEQGGEFSAKDYQDPPPAPLFDLDELTKWSLYRAVIAEFVATLLFLYITVLTIIGYSRQSDTTIKGNTECDGVGVLGIAWAFGGMIFILVYCTAGISGGHINPAVTFGLFVGRKVSLIRAFLYIVAQCLGAICGAGLAKGFQTSYYNRYKGGVNTVSDGYSKGTALGAEIIGTFVLVYTVFSATDPKRSARDSHVPVLAPLPIGFAVFMVHLATIPVTGTGINPARSFGPAVIFNNEKAWDDQWIYWVGPFIGAAVAAIYHQYILRGSAIKALGSFRSNA

SEQ ID NO: 13484 - protein, 501 aa, Suaeda liaotungensis
MSIPIPSRQLFIDGEWREPIKRNRLPIINPSTEETIGEIPAATAEDVEAAVSAARRALKRNKGRDWAATSGAHRARYLRAIAAKVSEKKDHFVKLETMDSGKPLDEAVLDIDDVSTCFEYFADQAEALDNKQKYPVKLPMDRFKSHVLRQPIGVVGLISPWNYPLLMATWKIAPALAAGCTAVLKPSELASVTCLEFGEVCNEVGLPPGVLNILTGLGPDAGAPLVSHPDVDKVAFTGSSATGSKVMGSAAQLVKPVTLELGGKSPIIVFEDVVDLDVAAEWTIFGVFWTNGQICSATSRLLVHESIAAEFVEKLVKWSKKIKISDPFEEGCRLGPVISKGQYDKIMKYISTAKSEGATILCGGSRPEHLKKGYFIEPTIVTDITTSMQIWKEEVFGPVLCVKTFSTEEEALELANDTEYGLAAAVFSKDLERCERVTKALEVGAVWVNCSQPCFCHAPWGGVKRSGFGRELGEWGIENYLNIKQVTSDISDEPWGWYKSP

SEQ ID NO: 13485 - protein, 288 aa, Porphyra purpurea
MSLSNWPLKKEQSKAHNIKSTKQITIPDGLWVKCFDCGLLMYSKVLKRNLKVCPQCSYHFQASSNERIDQLIDQGSWEPMDVHLISTDPLGFKDQKLYSQRLKDTAFKTSLQDAVQTGVGTMLGQKVCLGIMDFRFMGGSMGSVVGEKLTRLLEKATQERLPAIILCASGGARMQEGMLSLMQMAKISSALEMHKKENLLYLSVLTSPTTGGVTASFAMLGDLIIAEPKALIAFAGRRVIEQTIKEDLPDNFQSSEYLFEHGFLDLIVPRTQLRSKLIQILHLHTNNN

SEQ ID NO: 13486 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 13487 - protein, 181 aa, Lycopersicon esculentum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 13488 - protein, 355 aa, Eucalyptus botryoides
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCGPCNSDQEQYCNKKIWNYNDVYTDGKPTQGGFAGEIVVGQRFVVKIPDGLESEQDAVMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 13489 - protein, 393 aa, Rhizopus microsporus var. chinensis
MKFTLISSCIAIAALAVAVDAAPGEKKISIPLAKNPNYKPSAKNAIQKAIAKYNKHKINTSTGGIVPDAGVGTVPMTDYGNDVEYYGQVTIGTPGKKFNLDFDTGSSDLWIASTLCTNCGSRQTKYDPKQSSTYQADGRTWSISYGDGSSASGILAKDNVNLGGLLIKGQTIELAKREAASFANGPNDGLLGLGFDTITTVRGVKTPMDNLISQGLISRPIFGVYLGKASNGGGGEYIFGGYDSTKFKGSLTTVPIDNSRGWWGITVDRATVGTSTVASSFDGILDTGTTLLILPNNVAASVARAYGASDNGDGTYTISCDTSRFKPLVFSINGASFQVSPDSLVFEEYQGQCIAGFGYGNFDFAIIGDTFLKNNYVVFNQGVPEVQIAPVAQ

SEQ ID NO: 13490 - protein, 419 aa, Candida albicans
MQLSLSALTTVALALTSSLVDAKAHSIKLSKLSNEETLDASNFQEYTNSLANKYLNLFNTAHGNPSNFGLQHVLTNQEAEVPFVTPKKGGKYDAPLTNYLNAQYFTEIQIGTPGQPFKVILDTGSSNLWVPSQDCTSLACFLHAKYDHDASSTYKVNGSEFSIQYGSGSMEGYISQDVLTIGDLVIPGQDFAEATSEPGLAFAFGKFDGILGLAYDTISVNHIVPPIYNAINQGLLEKPQFGFYLGSTDKDENDGGLATFGGYDASLFQGKITWLPIRRKAYWEVSFEGIGLGDEYAELHKTGAAIDTGTSLITLPSSLAEIINAKIGATKSWSGQYQVDCAKRDSLPDLTLTFAGYNFTLTPYDYILEVSGSCISVFTPMDFPQPIGDLAIVGDAFLRKYYSIYDLDKNAVGLAPTKV

SEQ ID NO: 13491 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 13492 - protein, 478 aa, Pseudomonas putida
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLAADSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 13493 - protein, 334 aa, Arabidopsis thaliana
MPLLLRRFPSPSVVSSFFLRRSMASSTISSDIITPSNTKIGWIGTGVMGRSMCGHLIKAGYTVTVFNRTISKAQTLIDMGANVADSPNSVAEQSDVVFTIVGYPSDVRHVLLDPKSGALSGLRQGGVLVDMTTSEPSLAEEIAKAASFKNCFSIDAPVSGGDLGAKNGKLSIFAGGDETTVKRLDPLFSLMGKVNFMGTSGKGQFAKLANQITIASTMLGLVEGLIYAHKAGLDVKKFLEAISTGAAGSKSIDLYGDRILKRDFDPGFYVNHFVKDLGICLNECQRMGLALPGLALAQQLYLSLKAHGEGDLGTQALLLALERLNNVSVQSSDS

SEQ ID NO: 13494 - protein, 481 aa, Arabidopsis thaliana
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 13495 - protein, 493 aa, Catharanthus roseus
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 13496 - protein, 479 aa, Craterostigma plantagineum
MSQVDAEGVVDGLRRTYISGKTKSYEWRVSQLKALLKITTHHDKEVVEALRADLKKPEHEAYVHEIFMVSNACKSALKELHQWMKPQKVKTSLATYPSSAEIVSEPLGVVLVITAWNYPFLLALDPMIGAIAAGNCVVLKPSEIAPATSALLAKLLNQYVDTSAIRVVEGAVPEMQALLDQRWDKIFYTGSSKVGQIVLSSAAKHLTPVVLELGGKCPTVVDANIDLKVAARRIISWKWSGNSGQTCISPDYIITTEENAPKLVDAIKCELESFYGKDPLKSQDMSSIINERQFERMTGLLDDKKVSDKIVYGGQSDKSNLKIAPTILLDVSEDSSVMSEEIFGPLLPIITVGKIEECYKIIASKPKPLAAYLFTNDKKRTEEFVSNVSAGGITINDIALHFLEPRLPFGGVGESGMGSYHGKFSFDAFSHKKSVLKRSFGGEVAARYPPYAPWKLHFMEAILQGDIFGLLKAWLGWSS

SEQ ID NO: 13497 - protein, 468 aa, Azara celastrina
KASVRFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 13498 - protein, 468 aa, Caloncoba lophocarpa
KASVGFKAGVKDYKLNYYTPDYETKDTDILAAFRVTPQPGVPPEEAGAAVAAESSTGTWTTVWTDGLTSLDRYKGRCYDLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGLPIVMHDYLTGGFTANTSLAHYCRDNGLLLHIHRAMHAVIDRQKNHGMHFRVLAKALRMSGGDHVHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVAVEACVKARNEGRDLAREGNEIIREASKWSPELAAACEVWKEIKFEFPAMDTL

SEQ ID NO: 13499 - protein, 468 aa, Camptostylus mannii
  misc_feature (3)..(3): Xaa can be any naturally occurring amino acid
KAXVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVIPVASGGIHVWHMPALTEIFGDDAVLQFGGGTLGHPWGNAPGAVANRVALEACVKARNEGRDLARESNEIIREASKWSPELAAACEIWKEIKFEFPAMDTL

SEQ ID NO: 13500 - protein, 468 aa, Lindackeria sp. Pennington and Zamora 592
KAGVGFEAGVKDYKLTYYTPDYETKDTDILTAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFPAMDTL

SEQ ID NO: 13501 - protein, 468 aa, Lozania pittieri
KASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIQFEFPAMDTL

SEQ ID NO: 13502 - protein, 468 aa, Cephalomappa malloticarpa
KASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPNAYIKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGVPIIMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGRTLGHPWGNAPGAVANRVALEACVQARNEGRDLAREGNEIIREASKWSPELAAACEVWKEIKFEFEAMDTL

SEQ ID NO: 13503 - protein, 468 aa, Joannesia princeps
KASVGFKAGVKDYKLTYYTPEYQTKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAVDTL

SEQ ID NO: 13504 - protein, 468 aa, Excoecaria cochinchinensis
KASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13505 - protein, 468 aa, Pimelodendron zoanthogyne
KASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIRAASKWSPELAAACEIWKEIKFEFEAMDTL

SEQ ID NO: 13506 - protein, 468 aa, Heywoodia lucens
KASVGFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13507 - protein, 468 aa, Gonatogyne brasiliensis
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAIFARELGVPIIMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13508 - protein, 468 aa, Ricinocarpus tuberculatus
KASVGFKAGVKDYKLTYYTPDYQTKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13509 - protein, 468 aa, Bennettiodendron leprosipes
KASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKGLRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEIWKEIKFEFQAMDTL

SEQ ID NO: 13510 - protein, 469 aa, Oncoba spinosa
KASVGFKAGVKDYKLTYYTPDYETKDTDILAAFRVTPQPGVPPEEAGAAVAAESSTGTWTTVWTDGLTSLDRYKGRCYGIEPVTGEENQYIAYVAYPLDLFEEGSVTNMFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSIPGVLPVASGGIHVWHMPALTEIFGDDSVLQFGGGTLGHPWGNAPGAVANRVALEACVKARNEGRDLAREGNEIIREASKWSPELAAACEVWKEIKFEFQAMDTLD

SEQ ID NO: 13511 - protein, 468 aa, Xylosma buxifolium
KAGVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVIPVASGGIHVWHMPALTEIFGDDAVLQFGGGTLGHPWGNAPGAVANRVALEACVKARNEGRDLAREGNEIIREASKWSPELAAACEIWKEIKFEFQAMDTL

SEQ ID NO: 13512 - protein, 468 aa, Trimeria grandifolia
KASVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 13513 - protein, 469 aa, Salix przewalskii
KTGVGFKAGVKDYKLTYYTPEYETKDTDILAAFRVTPQPGVPPEETGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAQWGNEIIREASKWSPELAAACEVWKEIKFNFEAMDKLD

SEQ ID NO: 13514 - protein, 469 aa, Salix fragilis
KTGVGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFQALRALRLEDLRIPTAYVKPFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMMKRAIFARELGVPIVMHDYLTGGFTANTTLPHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFNFEAMDKLD

SEQ ID NO: 13515 - protein, 310 aa, Erwinia chrysanthemi
MTTKNIAIIGECMIELSRKARISIRGFGGDTLNTAVYISRQVKPDALDVHYVTALGTDSFSSEMMASWQKEGVKTDLIQRLDNKLPGLYFIETDATGERTFYYWRNDAAARYWLESPDADTISQQLAQFDYIYLSGISLAILNQASRARLLTVLRACRANGGKVIFDNNYRPRLWQSKEETRQAYSDMLACTDIAFLTLDDEDMLWGELPVDEVLKRTHGAGVMEVVIKRGADACLVSIQGEALLEVPAIKLPKEKVVDTTAAGDSFSAGYLSVRLNGGSAQDAAKRGHLTASTVIQYRGAIIPLEAMPA

SEQ ID NO: 13516 - protein, 398 aa, Pseudomonas putida
MHGSNKLPGFATRAIHHGYDPQDHGGALVPPVYQTATFTFPTVEYGAACFAGEQAGHFYSRISNPTLNLLEARMASLEGGEAGLALASGMGAITSTLWTLLRPGDEVLLGNTLYGCTFAFLHHGIGEFGVKLRHVDMADLQALEAAMTPATRVIYFESPANPNMHMADIAGVAKIARKHGATVVVDNTYCTPYLQRPLELGADLVVHSATKYLSGHGDITAGIVVGSQALVDRIRLQGLKDMTGAVLSPHDAALLMRGIKTLNLRMDRHCANAQVLAEFLARQPQVELIHYPGLASFPQYTLARQQMSQPGGMIAFELKGGIGAGRRFMNALQLFSRAVSLGDAESLAQHPASMTHSSYTPEERAHYGISEGLVRLSVGLEDIDDLLADVQQALKASA

SEQ ID NO: 13517 - protein, 394 aa, Aspergillus niger
MVVFSKTAALVLGLSTAVSAAPAPTRKGFTINQIARPANKTRTVNLPGLYARSLAKFGGTVPQSVKEAASKGSAVTTPQNNDEEYLTPVTVGKSTLHLDFDTGSADLWGFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAHYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 13518 - protein, 247 aa, Sorghum bicolor
MAPQFAAAGFLTGLLALATFASCNTEGDILYKQRLAWEDPNNVLQSWNSTLANPCTWFHVTCNNNNFVIRVDLGNAGISGPLLPDLAEIQNLQYIELYGNGLNGSIPETLGNLTNLISLDLWDNLLTGEIPTTLGSVSTLRYLRLYQNNLTGPIPSSFGNLTSLLESKLQENSLSGAIPASLGNIKALQFSRLNDNMLTGTVPSKSFPLSTFGNLTELNTDRNNLDGTRTSSGLRVTAIIQDALKTA

SEQ ID NO: 13519 - protein, 118 aa, Saccharomyces cerevisiae
ASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 13520 - protein, 503 aa, Arabidopsis thaliana
MAITVPRRQLFIGGQWTEPVLRKTLPVVNPATEDIIGYIPAATSEDVELAVEAARKAFTRNNGKDWARATGAVRAKYLRAIAAKVIERKSELANLEAIDCGKPLDEAAWDMDDVAGCFEYYADLAEGLDAKQKTPLSLPMDTFKGYILKEPIGVVGMITPWNYPLLMAVWKVAPSLAAGCTAILKPSELASLTCLELADICREVGLPPGVLNILTGLGTEAGAPLASHPHVDKIVFTGSTTTGSSIMTSAAKLVKPVSLELGGKSPIIVFDDVDIDKAVEWTMFGCFWTNGQICSATSRLLVHERIADEFLDKLVKWTKNIKISDPFEEGCRLGPVVSKGQYERVLKFVSNARNEGATVLCGGVRPEHLKKGYFVEPAIVSNVTTSMEIWREEVFGPALCVKTFSTEDEAIQLANDSQYGLAGAVLSNDLERCDRVSKAFQAGIVWVNCSQPCFCQAPWGGTKRSGFGRELGEWGLENYLSVKQVTQYISDEPWGWYKPPSKL

SEQ ID NO: 13521 - protein, 343 aa, Arabidopsis thaliana
MGEDAISGNLKNLTIDTRDSETLVVCFGEMLIDFVPTVGGVSLAEAPAFKKAPGGAPANVAVGVSRLGGSSAFIGKVGDDEFGRMLADILRLNNVDNSGMRFDHNARTALAFVTLRGDGEREFLFFRHPSADMLLLESELDKNLIQKAKIFHYGSISLIEEPCRSTQLVAMKIAKAAGSLLSYDPNLRLPLWPSEEAARKEIMSIWNLADVIKISEDEITFLTGGDDPYDDDVVLQKLFHPNLKLLVVSEGPNGCRYYTQEFKGRVGGVKVKPVDTTGAGDAFVSGLLNSLASDLTLLKDEKKLREALLFANACGAITVTERGAIPAMPSMDAVQDLLSSTRS

SEQ ID NO: 13522 - protein, 396 aa, Arabidopsis thaliana
MAPVKQKKKNKKKPLDKAKKLAKNKEKKRVNAVPLDPEAIDCDWWDTFWLRNSSPSVPSDEDYAFKHFFRASKTTFSYICSLVREDLISRPPSGLINIEGRLLSVEKQVAIALRRLASGDSQVSVGAAFGVGQSTVSQVTWRFIEALEERAKHHLRWPDSDRIEEIKSKFEEMYGLPNCCGAIDTTHIIMTLPAVQASDDWCDQEKNYSMFLQGVFDHEMRFLNMVTGWPGGMTVSKLLKFSGFFKLCENAQILDGNPKTLSQGAQIREYVVGGISYPLLPWLITPHDSDHPSDSMVAFNERHEKVRSVAATAFQQLKGSWRILSKVMWRPDRRKLPSIILVCCLLHNIIIDCGDYLQEDVPLSGHHDSGYADRYCKQTEPLGSELRGCLTEHLLR

SEQ ID NO: 13523 - protein, 457 aa, Arabidopsis thaliana
MAPAQNPISSQHVVVIGAGAAGLVAARELSREGHTVVVLEREKEVGGLWIYSPKAESDPLSLDPTRSIVHSSVYESLRTNLPRECMGFTDFPFVPRFDDESRDSRRYPSHMEVLAYLQDFAREFNLEEMVRFEIEVVRVEPVNGKWRVWSKTSGGVSHDEIFDAVVVCSGHYTEPNVAHIPGIKSWPGKQIHSHNYRVPGPFENEVVVVIGNFASGADISRDIAKVAKEVHIASRASEFDTYEKLPVPRNNLWIHSEIDTAYEDGSIVFKNGKVVYADSIVYCTGYKYRFTFLETNGYMNIDENRVEHLYKHVFPPALSPGLSFVGLPSMGIQFVMFEIQSKWVAAVLSRRVTLPTEDKMMEDISAWYASLDAVGIPKRYTHKLGKIQSEYLNWVAEECGCPLVEHWRNQQIVRGYQRLVSHPETYRDEWDDNDLMEEAYEDFARKKLISFHPSHIL

SEQ ID NO: 13524 - protein, 413 aa, Kluyvera cryocrescens
MAESSPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVELPKASMYVWAKIPDKYAAMGSLEFAKKLLQDAKVCVSPGIGFGEYGDTHVRFALIENRDRIRQAIRGIKAMFRADGLLPSEHKSRIDFCVA

SEQ ID NO: 13525 - protein, 493 aa, Nostoc sp. PCC 7120
MQLNHNGVHSEGHSFVLPQICPSQSSVESDFPSNRVRSVPGAASSHYLERQQARESNARSYPRRIRIAISEAQGIYLKDADGNVYIDCLAGAGTLALGHNHPVAIEAMRRVLDTGLPLHTLDLTTPVKDQFVEEIFASLPAEFAQNAKIQFCGPSGADAVEAAIKLVKTATGHRSVLSFHGGYHGMTHGALSLTGNLNPKQAVTGLMPDVHFLPYPYHYRCPFGLGGEAGQITSSRYIESILDDPESGIVTPAAMILEVVQGEGGVIPAPDDWLREMRRITRDRHIPLIVDEIQTGLGRTGKLYAFEHSGIVPDVLLLSKAIGGSLPLSVVLYNKALDKWSPGAHAGTFRGNQMAMAAGTATLQYILENSLTEHAAAMGDRLLKHLHQIQGETYCIGEVRGRGLMVGVEIINPQASADRRGKYPVHPQLASCIQAECLRRGLIVELGGRFGSVVRFLPPLIVTPAQIDSISEIFSSAVQAAEKQVLSVLSQVS

SEQ ID NO: 13526 - protein, 270 aa, Nostoc sp. PCC 7120
MPTISDHFQSLRQRQQCALIPFITAGDPDLQTTAEALRILDRHGADFIELGVPYSDPLADGPVIQAAATRALQRGTKLEQVLEMLETVIPSLQAPIILFTYYNPILHRGIQSFLETIAAVGVRGLVVPDLPLEEAEELIKTAANFGIEVILLVAPTSSQNRIEAIARQSQGFIYLVSVTGVTGIRSQIQDRVQHLITDLRHVTDKPIGVGFGISAPEQARQVKEWGADAVIVGSAFVKRLAEGSPSQGLQAVEKLCQELKTAITRVEARV

SEQ ID NO: 13527 - protein, 318 aa, Nostoc sp. PCC 7120
MRAMAIANFGSPEVFTEVEVNKPTPANNEVLVKVYATSVNPADCGMRRGFFGPRVQLPAILGFDVSGVVEAVGENVRDFQVGDEVYYAIPHELGGGANAEYHAFPSSMIAKKPNNISHLEAATVPVAGGTAWAALITRANLQVGETVLIHGGAGGVGTFAIQIAKAAGAYVYTTCGGYDIDFVKSIGADRAIDYRNEDFTNIIMQETGGAGVDITFTTVAGETLAKSLLVTKENGRAVTITGVTGDLNTAIFKNITIHFVHLDDTHSKLNALRSLIERRQIKPIFGITYPLNQLAAAHKKLEEGGQGIRGKIAIEVNS

SEQ ID NO: 13528 - protein, 165 aa, Nostoc sp. PCC 7120
MLACVVVLVLAQVGNKQDSAIAANLPQTPLATISVTENNTPIKKNIMSEASKPPVTTDSGLKYVEIEEGTGATPKSGQTVVVHYTGTLEDGTKFDSSRDRNRPFSFTIGVGQVIKGWDEGLSTMKVGGRRQLIIPSELGYGARGAGGVIPPYATLLFDVELLEVK

SEQ ID NO: 13529 - protein, 235 aa, Nostoc sp. PCC 7120
MTQNRSEKPIVISPSILSADFSRLGDEIRAVDAAGADWIHVDVMDGRFVPNITIGPLVVEAIRPVTKKPLDVHLMIVEPEKYVEDFAKAGADIISVHCEHNASPHLHRTLGQIKELGKQAGVVLNPGTPLELIEYVLELCDLILIMSVNPGFGGQSFIPGVVPKIRQLRQMCDERGLDPWIEVDGGLKANNTWQVLEAGANAIVAGSAVFNAKDYAEAITNIRNSKRPTPELAKV

SEQ ID NO: 13530 - protein, 355 aa, Nostoc sp. PCC 7120
MTHLFEPLRIREVTFRNRIALSPMCQYSSTNGFANDWHLVHLGSRAVGGAGLVMTEAAAVEARGRISPQDLGIWSDAHIEALARTVGLIHNFGAVAAIQLAHAGRKASTSKPSKGGKFLDESHEGWRPVVSSSAIAFSKESPVPEALSIEGIQQVIQAFVQATKRSLQAGFKVIEIHAAHGYLLHQFLSPLVNQRQDDYGGSFENRTRLLREVVEAVREVWPESYPLFVRLSATDWVDKGWDIEQSIAISDKLKSLGVDLIDCSSGGVIPGINIPVKPGYQSQFAERIRKEAHIPTGAVGLITSPEQADQIIRSGVADIVLLGRELLRNPYWPHLAAKELGHEKHWPVQYDRAWL

SEQ ID NO: 13531 - protein, 306 aa, Nostoc sp. PCC 7120
MFPVIYSDEFLDHKTGKYHPESPERLTAIVNALKQAAFAEKIRWIEPTPALENSSVMPLLVKVHSPGYVNKVREIATTGGGYLDGDTPVSPRSYDVALLAVSAWLNGIDTVLETANPAFVLARPPGHHAEGDAGMGFCLFSNAAIAAHYALEQPGIKRVAIIDWDVHHGNGTQAIVEINPQIAYCSLHQYPCYPGTGRATEKGFHNNVLNLPVPPGSDMAVYQPLWEKKIMPFLEDFQPDLLIVSAGYDGNADDPLASVNLQPKDYGLFTNYCLEITRKMLFGLEGGYDLPTLSQSVLATIASCLA

SEQ ID NO: 13532 - protein, 328 aa, Nostoc sp. PCC 7120
MRAMILDAPRQPLRLTELPVPKPNSEQVLIRVHACAVCRTDLHIVDGELTHPKLPLILGHQIVGTIEALGEKVDQFHLGQRVGVPWLGHTCAHCPYCLSGRENLCDYAEFTGYNLDGGYADYTVADHRFCFPLDPSYPDLQAAPLLCGGLIGYRAYNMTGNAEKLGFYGFGSSAHILIQLARYQGRKVFAFTRPGDTVGQEFARQLGANWAGDSDVLPPEPLDAAIIFAPVGKLVPTALRAVAKGGVVVCAGIHMSDIPSFPYSILWEERVLRSVANLTRQDGEEFLTIAPQIPIRTEVNSFPLTQANEALDALRSGKIEGSAVLVMK

SEQ ID NO: 13533 - protein, 144 aa, Nostoc sp. PCC 7120
MTETATAPLTGKALLAKVKELSTLPRRERAKQCGYYTVTKNNQVRVNLTDFYDALLSARGIPLSPEAPKDGRGREPTYRVSVHQNGQIVIGATYTKAMGLKPGDEFEIRLGYKHIHLIQLGESDKKLSPDLDIDESDEDLEDEE

SEQ ID NO: 13534 - protein, 498 aa, Nostoc sp. PCC 7120
MAINTGKNKLMNRHIRPWQRLLVLAIGSMVFAVFAPTIVQAVDTPTLESLSETTIKLQISIDTTWVLLSGFLVFFMQTGFAMLEAGLVRQRSVVNTLLENFIDAAVTVLAWWAVGFGIAFGTSAGGLFGIDTFFLSQLPGADGSYPLGAPGSTAAINTYTLFFFQFAFAATASTITTGSMAGRTDFIGDLIYSAIMGAISYPIIVHWAWNSNGWLGKLSYHDFAGGSIVHTVGGWTALVGAYLLGPRPDRPPWGKLPPAHNLALATLGTMILWFGWYGFNPGSTLGTANPGLIGLVTINTTLAAGAGALAALIFLYVRTGKWDLVYCLNGSLAGLVAITAPCAYVAPWASVLIGLTGGIAVVLGVSLIESLHIDDPVGAFSVHGISGMMGTLSIGFLGQEELTLNQKAGLLLGGGFDLLGIQMLGIVAITVFTVAFAFLMYGGLKAMGHLRVNAEADRIGIDTYEHGASVWPDVYSVEELSKPQEHTKISENKTLEGE

SEQ ID NO: 13535 - protein, 161 aa, Nostoc sp. PCC 7120
MKSQEEELLDKQGEDLKPDSSWDQALLATTAPLIQNISQTQLQQISPAALAYVGDAIYELYVRMFYLLPLQRSDAYHRLVVAQVRAETQALHLRSLTPYLRASELEIVRRGRNAAAGRPKRVNPEIYQQATSLEALIGYLYLTDFPRLTELLQKIHLEKEE

SEQ ID NO: 13536 - protein, 365 aa, Nostoc sp. PCC 7120
MNYLAKYSYFESIFKPQSGNHSKWKNTTATDVTQALGNVPIVKLRNISPVCAIAECFLKLESCNPGGSIKEKNAVYLVTCAEEEGLLVPGGTIIESSSGNFGVGLAMVGAVRGYRVIIVVDAKTPPPFRRMLKAYGAELVDVPLHEADESGSMQKARMKRAKELAATIPDAWYPCQHLNPLNTEAHSYYTAREIEAHFADELDAVVVGVSTAGQIMGIARYLRPRFPKIRIIGVDVVGSVIMGTSAKPYKMTGIGLSFFPPNLDLSLLDRAYIVPEDLAYSVCHALARREGLLLGASTGAIVAGGLHLARELGRGARILMINPDRGDRYLETVYDSEWLERHGFTLKQDSHLDDAIASLSPVYFE

SEQ ID NO: 13537 - protein, 311 aa, Nostoc sp. PCC 7120
MKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKFEFNKKAQSAGK

SEQ ID NO: 13538 - protein, 402 aa, Nostoc sp. PCC 7120
MSDEAERQRGNNLYKNSPLLPVSISQVSTSQLRETEIMSTNINLFSSYQLGELELPNRIVMAPLTRQRAGEGNVPHQLNAIYYGQRASAGLIIAEATQVTPQGQGYPHTPGIHSPEQVAGWKLVTDTVHQQGGRIFLQLWHVGRISHPDLQPDGGLPVAPSAIAPKGEVLTYEGKKPYVTPRALDTSEIPAIVEQYRQGAANALAAGFDGVEIHAANGYLIDQFLRDGTNQRTDEYGGAIENRARLLLEVTEAITSVWDSQRVGVRLSPSGTFNDIRDSHPLETFGYVAQALNRFNLSYLHIFEAIDADIRHGGTVVPTSHLRDRFTGTLIVNGGYTREKGDTVIANKAADLVAFGTLFISNPDLPERLEVNAPLNQADPTTFYGGGEKGYTDYPFLAVANK

SEQ ID NO: 13539 - protein, 167 aa, Nostoc sp. PCC 7120
MYVSLLPYTDMKKKNSTTLIFNFQPLAKLITTVVISCLVVLISWVWTPSAIALTQIKLSDLSYQECPAELAQGTVATNSSTSANCFIVTGKAENGTYKTVYDADIYGRIYDANNDPILQNRTRLGSIAEVPPGTSDFELRITVPANQPLPLKLKQFKASGFSAQVRK

SEQ ID NO: 13540 - protein, 404 aa, Nostoc sp. PCC 7120
MQFSQRLHPLQSNVFADMDKAKSLALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFADIPTDVLAQSRMMVLSYPHNPTAAIAPLSFFKEAVAFCQEHNIALVHDFPYVDMVFENAGNLNTNLPQSPIPNHQSLVPSILQADPDKSVSIEFFTLSKSYNMGGFRIGYAIGNAQMIQALRQIKAAVDFNQYRGILNGAIAALTGPQAGVEAAVSTFCQRRDAFINALHHIGWYVPTPKATMYIWAKLPSSWSQNSIEFCTQLVRQTGVAASPGAGFGKSGEGYVRFALVHEPSILKIAVERMSNFL

SEQ ID NO: 13541 - protein, 459 aa, Nostoc sp. PCC 7120
MTTIPIWDVQQTPELNISAADYSLLTDLYQLTMAACYTGEGVEQRRASFELFVRRSPEGFGYLIAMGLAQALEYLEKLRFSPEQIAALQATGIFAHAGEGFWSLLAEGRFTGDVWAVPEGTAVFANEPLLRVEAPLWQAQLVETYLLNTLNYQTLVATRAARLRDIAGEQATLLEFGTRRAFSPQASLWAARAALAGGLDATSNVLAALQLGQQPSGTMAHALVMALSAMEGSEEQAFSAFHRYFPGAPLLIDTYDTIAAAQHLAEKVNTGKMELSGVRLDSGDLVSLSKQVRSLLPDVSIFASGDLDEWEIAKLQAAGAEIDGYGLGTKLVTGSPVNGVYKLVEIDDIPVMKKSSGKTTYPGRKQIFRSFGDGQVQADRLGLITDTPLITEKPLLELVVKEGQRLQPRETLSAIRQRTAASVASLPEQTRRLDNPVPVPIQISTALQDLTEVTLQRLN

SEQ ID NO: 13542 - protein, 319 aa, Nostoc sp. PCC 7120
MRIANDVTELIGGTPLVKLNKIPQAEGVVARIVVKLEGMNPASSVKDRIGVSMINAAEAEGLIIPGKTILVEPTSGNTGIALAMVAAARGYRLILTMPETMSQERRAMLRAYGATLELTPGTEGMRGAIRKAEEIVASTPDTHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMIQPSFGERYLSTPLFQDLTNETAGVS

SEQ ID NO: 13543 - protein, 476 aa, Nostoc sp. PCC 7120
MRRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 13544 - protein, 411 aa, Nostoc sp. PCC 7120
MGLGINLFGHNPPFIQTAISEQLQQGMHIGVQNTLAGEVAQLISELTGAERVTFSNTGTEAVMTAVRIARAATKRPKIAIFTNSYHGHFDSVLVRATMTEYAKKAARRIIAAKSGSFIGRLAQPIQALFTANLNPKAVPAAPGIPNSAAADVLILEYGNEHSLKLIRKHRRELAAVLVEPVQSRCPELQPREFLQQLRQITQELGIVLIFDEMVTGFRIHPGGAQAHFGVKADIATYSKIVGGGLPLSVIAGKASYMNYIDGGQWQFGDDSTPQVPTTFFAGTFCKHPLALAAARATLQHLKISGIELHNELNQRTTQLVNDLNTHMTQQGIAIKFTSFGSFFAVAASQSAVPPMAINLLSYHLITKGIHLRQGDKGGFLSTAHTEEDINLIKKAFIDSINELRNEGFINN

SEQ ID NO: 13545 - protein, 403 aa, Nostoc sp. PCC 7120
MSFDWITPADRIQQLPPYVFARLDELKAKAREQGIDLIDLGMGNPDGATPQPVVDAAIQALQDPKNHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALDRIKQAGIRYRPEALVSAPE

SEQ ID NO: 13546 - protein, 369 aa, Nostoc sp. PCC 7120
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 13547 - protein, 335 aa, Nostoc sp. PCC 7120
MKAVLMTAPGNPEVLQLQEVPNPGVPVGSTELLVRLVAAGINPIDTKLRKRGTFYPEQMPAILGCDGAGVVEAVGAGVQGFRVGDAVYFCNGGLGGHQGNYAEYTIVDERFAAHKPASLTFAEAAAAPLVLITAWEALYERGRLEPKERVLIHAGAGGVGHVAIQLAKLKGAIVSTTVGSEDKANFVKQLGADHVILYKNTDFAQAALDWTNGEGVDLAFDTVGGETFHKTFPAVRIYGDIVTILEPDANTVWKVARNRNLRIGLELMLTPMLLNLVEAQQHQAEILTECADWIDQGKLKIHVSHKFPLQDAAKAHQLLESGSIAGKIVLLISDE

SEQ ID NO: 13548 - protein, 333 aa, Nostoc sp. PCC 7120
MNMQNLQNFRDYYEILGVTKDATNEDIKKNYRRLARQYHPDLNPGNKDAEEKFKIIGEAYEMLSDATKRAQYDQFSRYWKQKGFPKQTPKSKAWGDSRNGERNGNENVDPSQFTNFEDFLNQVIGVGSRRDSKNGASTNTTTDPFRSPKSRVEYTVPKNPSRPARRDIEARLTLPFEKAYSGGNERIRLEDGRSLEVTMPPGMVTGQTIRLRNQGISGGDLYLKITVEPHPLFKLEGTNIFCQVPVTPSEAVLGGQVEAPTLDGPVKMTIPPGVRSGQRFRLANKGYPSDNGKRGDQLVEIQILTPKTISQEEKELYEKLRQIETFKPRADLI

SEQ ID NO: 13549 - protein, 411 aa, Nostoc sp. PCC 7120
MPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 13550 - protein, 460 aa, Nostoc sp. PCC 7120
MLTIETSKIKEIIQQQRNFFQAGQTKDINFRLEQLKKLRKLVTDNETAITKALKADLNKSEYEAYFAEVGVIKEIDYAIKNLKNWSKPKKADVPLDFFSYSARIYPEPLGVVLIICPWNYPFALTISPLVGAIAAGNCAIIKPSELAPHTSNLAAQLISKCFPSEYVAVVEGGAETSQELLAEKFDHIFFTGGTAIGKIVMEAAAKHLTPVTLELGGKSPCIVDSNIHLEYTAKRIAWGKFINAGQTCIAPDYLLVNQKIKKDLIAAIQKNLQEFYGDNPIDSPDYGRIISHRHFERLAKFLKNGQVIVGGETNYEDKYIAPTLLDNVSLADPVMQEEIFGPILPMIEYTDIKDAIALINSQPKPLALYIFSQNKALQQQVLQETSSGGVCINDTIMHVGVSSLPFGGVGDSGIGSYHGKASFDTFSHYKSVLKNAFWLDLDWRYAPYKNKLSLLKRMMK

SEQ ID NO: 13551 - protein, 498 aa, Nostoc sp. PCC 7120
MKTPLNCQNYINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVYVDFSGSLQRAQIDNRS

SEQ ID NO: 13552 - protein, 507 aa, Nostoc sp. PCC 7120
MAKPKTFYICNECGAESPQWFGKCPACGTYNSLEEQITIQSSVDVPKGGVSGWHASQNNGKAPVKPPKARASLTFDQITDRQIARWESGYGELDRVLGGGVVPGSMVLIGGDPGIGKSTLLLQVSNQLAQRYRILYVTGEESGQQVKLRASRLGVAKCLSVVGDDQQEESEQTSPVSIAESVGADLYVLPETDLEEILREVDSLKPNVAVIDSIQTVFFPALTSAPGSVAQVRECTAALMKVAKHEDITMLIVGHVTKEGAIAGPKVLEHLVDTVLYFEGDRFASHRLLRTVKNRFGATHEIGIFEMVANGLREVPNPSELFLGNRDDPAPGTAIVVACEGTRPIVVELQALVSPTSYPSPRRAGTGIDYNRLVQILAVLEKRVGIPMSKLDSYVASAGGLNVEEPAVDLGIAIAIVASFRDRIVDPGTVLIGEVGLGGQVRSVSQMELRLKEAAKLGFKKAIVPKGQKFPDFDIEIIPVAKVIDAIIAAIPHQELTEEDFNPDEDE

SEQ ID NO: 13553 - protein, 475 aa, Nostoc sp. PCC 7120
MSASSNSSKIKFGTDGWRGIIADDFTFPNVRKVTRAIASYLETAYTKDRPVLIAYDTRFLADQFAQTAAQVLADLGWNVKVTDRDCPTPVIAYNARHLNSAGALMFTASHNPAPYCGIKYIPDYAGPATPEITDTIVANIESASDELPSGKPSGTISTFDPKPDYLQFIYTLLDIERIKSAQLKVKYDALYSTSRGYLDEVLLESGVQLESFHTWRDVLFGGGMPEPKGEQLVELVEAVRRDHADLGLATDGDSDRFGIVDELGNVLTPNTVLLVLARHLIKNKGKTGAIVRTVATTHLLDNFAAKYGLTIYETAVGFKYIGEKMRETAVLIGGEESGGLSIIGHIPEKDGVLADMLIAEAIAYEGKPLSQLVKEAIAEADGPLYNNRLDLHLTEAHKVAVIDSFTKNPPSEVAGIKVKEVGRKDGIKLYLEEGSWVLLRPSGTEPLVRVYLETNSPEKLSKLEQELESAIAKLG

SEQ ID NO: 13554 - protein, 418 aa, Nostoc sp. PCC 7120
MNPDESQTPEPIDEWLEQIQQENPKLENPENSSEESVLVIEGQTPLVEPLSVSNEELANSTDNVTAESTDDLVQPLETETTLLGSELPNNPLYTEAEQRIAELQRTEAALTKEIANLQATYKILQGQLSETQTALGRIVQESLAQLEQRKQALQISVEQLERRQERIRNEMRTTFAGASQDLAIRVQGFKDYLAGSLQDLAVSAEQLQLVPAVVEREKAPVKDTKPAEPQAGTPQFAQQQFQDTTKQIRRLIDQYRNKPDYYGPAWQLRRTFEPVHAERVANWFFNQGGRGALRTMGSRLQNILIASAAISILHKLYGDRVRTLVLANTPERLGEWRRGLQDCLGIGRPDFGPDRGVVLFEAPDALAQKADRFVKANQLPLILIDDSEEQISLALLQFPLWLAFAPDPKAMRNTDDDF

SEQ ID NO: 13555 - protein, 248 aa, Nostoc sp. PCC 7120
MYMAEPTSIIIAEDVHKWYGKFHVLQGVSLTVNRGEVVVLMGPSGSGKSTFIRTFNALEAYQQGRITIDGITLSHDLRNIDAIRREVGMVFQQFNLFPHLTVLQNITLAPIWVRRSKKAQAEESAMQLLERVGILEQANKYPGQLSGGQQQRVAIARALAMQPKIMLFDEPTSALDPEMVREVLDVMRSLARDGMTMVVVTHEVGFAREVADRVVLMDGGHLVESASPDNFFTKPQEERTRKFLSQIL

SEQ ID NO: 13556 - protein, 327 aa, Nostoc sp. PCC 7120
MRVFVTGATGFVGANLVRLLLQQGYTVKTLVRPQSNLGNLRGLDVEIVEGDFDNQFLWQQMSGCRYLFHVAAQYSLWQKDRDLLYQNNVLGTFQVLEAAQKAGIERTVYTSSVAAIGVNPSGEIADETYQSPVDKLIGHYKKSKFLAEQEAVQAAAKGQDIVIVNPSTPIGPWDIKPTPTGDIILRFLRRQMPAYVNTGLNLIDVRDVAWGHLLALEKGKSGDRYILGHQNLSLQQLLEKLAEITGLPAPQWTVPGWLPLSVAWMEEKILAPLGKTPSVPIDGVRMAQQTMYYDASKAVKELGLPQSPVDIALKDAVNWFVSQGYVK

SEQ ID NO: 13557 - protein, 390 aa, Nostoc sp. PCC 7120
MQFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQDAGIRYA

SEQ ID NO: 13558 - protein, 290 aa, Nostoc sp. PCC 7120
MTLSVAHLGPPGTYAEQATIFYVKWLTHNTGLEAVLHPYSSIAQSLQALAQGETQLAVVPVENSIEGSVTMTMDTMWQMDSLQIQSALVLPIAHALISCANSLAGIKTVYSHPQALAQCQGWLREFLPDVQLIPSNSTTEALEKLEQDLAVGAIASSRSAELYNLPILASRINDYPENCTRFWAISHAESGITHQLPLQKLTHTSIAFSVPANVPGALLKTLQVFAHLDINLSRIESRPTKRSLGEYLFFIDLEADVNTPQMKSALVELTTYTEVLKIFGSYSVISANNQ

SEQ ID NO: 13559 - protein, 140 aa, Nostoc sp. PCC 7120
MAQTQETTTKTHTLPLPTTITSRGVAATELRPWGSFTVLEEGRGYKIKRIEVKPGHRLSLQMHHHRSEHWIVVSGTARVVCGEKEILLGNNQSTYVPQCTAHRLENPGVIPLVLIEVQNGEYLGEDDIIRYQDDYSRTSN

SEQ ID NO: 13560 - protein, 324 aa, Nostoc sp. PCC 7120
MDIKNGFIGTVGNTPLIRLNSFSEETGCEILAKAEFLNPGGSVKDRAALYIIQDAEEKGLLKAGGTVVEGTAGNTGIGLAHICNAKGYKCLIIIPNTQSQEKIDALTALGAEVRPVPAVPYKDPNNYVKLSGRIAAELDNAIWANQFDNLANRRAHYETTGPEIWTQTDGKVDAWVASTGTGGTFAGVAMYLKNQNPAIKCVVADPLGSGLYSYIKTGDIKIEGNSITEGIGNSRVTANMEGAPTDDAIQIDDHEALRVVYQLLRKDGLFMGGSTGINVAGAVALAKQLGPGHRIVTILCDSGSRYQSRIFNRDWLASKGLTVD

SEQ ID NO: 13561 - protein, 315 aa, Nostoc sp. PCC 7120
MSLTFVPPPIQKINSEIANNAGVEIYVLRLDLMHPWVNGNKWYKLKYNLLEAKEKSYTKLLTFGGAYSNHIFATAAAGNLLGFQTIGIIRGEETLPLNPTLSFATQQGMQLVYVDRETYRQRNSTTLHTDLRKRFGEVFIIPEGGSNLNGVRGCLEIISAATQVFDIVCVACGTATTLAGIALALEPQQRVIGFPVLKNGGFLAQDIAQLMKNYVAAGLPISSSSPASWELVCDYHFGGYAKVKDDLILFSHQFTQSYGVPLDYVYTAKMFYGVMDLLKQRYFTKGDGLRPTVGHRILMIHTGGLQGNIGMSERL

SEQ ID NO: 13562 - protein, 135 aa, Nostoc sp. PCC 7120
MTQSENNGQLEANDSSSHSGSRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVENK

SEQ ID NO: 13563 - protein, 320 aa, Nostoc sp. PCC 7120
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALFAAIRVAQRPENAGRLIVLIQPSFGERYLSTPLFQDLETKATASIS

SEQ ID NO: 13564 - protein, 333 aa, Nostoc sp. PCC 7120
MAATDFKDYYAILGVSKTATPEEIKQAFRKLARKYHPDVNPGNKQAEASFKEVNEAYEVLSDADKRKKYDQFGQYWRQVGEGFPGGGAGVDMGGVDFSQYGNFDEFINELLGRFGGAAPRGGRQSYSYRTPGGRPGGGFGGFNDFGFQDVGAAGGGQDAEATISLTFAEAFAGVQKRFNLGNETIDVRIPAGTKPGTRLRVRGKGQFNPMTQQRGDLYLKVEFQPHSFFQIEGDNLACEIPITPDEAALGASIDVPTPDGSVNVKLPAGVRSGQSLRLRGKGWPIAKGGRGDQFVKVAIVPPKDMSQQEREYYEKIRAIRSYNPRSHLQQVKL

SEQ ID NO: 13565 - protein, 475 aa, Nostoc sp. PCC 7120
MSHEFDYDLVIIGAGVGGHGAALHAVSCGLKTAIIEAADMGGTCVNRGCIPSKALLAASGRVRELRDAHHLKSLGIQIGNVEFDRQAIANHANNLVSKIQGDLTNSLKRLGVDIIRGWGKIAGTQKVTVTGDGGEKTITAKDIILSPGSVPFVPPGIEVDGKTVFTSDQGVKLETLPEWVAIIGSGYIGLEFSDIYSALGCEITLIEALDQLMPGFDRDIAKLAERVLITPRDIETKVGIYAKKVIPGSPVVIELADFKTKEVVDVIEVDACLVATGRIPATKNLGLESIGVELDRRNFIPVDDRMAVLSAGEVVPHLWAIGDANGKMMLAHAASAQGIVAVENIIGRERTVDYRSIPAAAFTHPEVSYVGLTETGAKELGQAEGFEVATSRSYFKGNSKALAENEADGIAKVIYRKDTGEVLGVHIFGLHASDLIHEASAAVANRQTVQTLAHLVHAHPTLSEVLDEAYKRAIV

SEQ ID NO: 13566 - protein, 307 aa, Nostoc sp. PCC 7120
MKGFDRLDTVDLSNWVTLAKTKTNCGRVVERIPKLAVADTAWFAVHICCQSGKFYSEGDTQCVFPLMSVIKPFTFLYLLEHMGVEKVLSWVGTKPSDAPFNSLEQLVADGGYPRNPMINSGAITLADKLPGEDADHRTRFFCKWLNQLAGSQIQLDESMLASVRLSRSPANQAIANYLAEKGYLEDLDVALDTYEQICCLSGTVEDLALLGKLLALESSSISPQHQQLVNSVMLTCGLYEASAEYAVTIGLPMKSGIGGGLLAIVPTAGAIACYSPALDRIGNPVGAIAFVEVLSRSLGLCGRFSHL

SEQ ID NO: 13567 - protein, 266 aa, Nostoc sp. PCC 7120
MTAISDRFETLKQNQECALIPFITAGDPDLETTAAALKILDSNGADFIELGIPYSDPLADGPVIQAAATRALQNGTKLERVLEMLKATIPSLRAPIILFTYYNPILHRGIDKFLEQIAAVGVAGLVVPDLPLEEAAGLLKPATERGIDLILLIAPTSSSERIEAIAHSSQGFIYLVSVTGVTGVRSQVEVRVSDLLRQIRQVTDKPIAVGFGISQPEQATQVKEWGADGAIVGSAFVQRLSAGTPAEGLSAIAEFCQSLKAAIKTS

SEQ ID NO: 13568 - protein, 217 aa, Nostoc sp. PCC 7120
MTVTQLSAQELFRAAYDNRYTWDKDFPGYSADITFKDDDKVITGQVIVNAELKAEVLGVDDESAKKAIHGQAWEIAIHRVRRTFEETHGANTFRYGATDENGAVEILMGGKAEGDRYKVQNNVVTLVHRHIHGVVVTINTFGVHDTGAGYLSHTYDSVYHEPKTGEQRGGVSNFVDEYEKVGNYFILNRREIRTATAGKIAVQEFAFSNIQLLTPGA

SEQ ID NO: 13569 - protein, 381 aa, Nostoc sp. PCC 7120
MNMAQTVTQNPRGVKTLLPLDVELRNVFKFFNQEPAVHGVDLDVRQGEFFSILGPSGCGKTTTLRLIAGFEQVDAGKLLIQGQPMTNIPPYRRPVNTVFQSYALFNHLNVWDNVAFGLRLKKSRKSEVESRVKEALKLVKMESLRSRFPSQLSGGQQQRVALARALVNRPAVVLLDEPLGALDLKLRKEMQVELSNLHKNLGLTFVMVTHDQEEALSLSDRIAVMNQGKIEQIGTPQEIYERPKTSFVADFIGDTNLFSGEITVLEAEYIQIVTKTGLTIVVARNEDTPAELLKPVVVSVRPEKIQLSLYPPSSLNNCFEGRLINVMYLGTHVNYVVQLINGMNINVLQPNTFGNLPDRETPIYAWWAESDCLAINQMTND

SEQ ID NO: 13570 - protein, 478 aa, Nostoc sp. PCC 7120
MPVIASSIKFGTDGWRGVIGDEFTFERLALVAPVAAKVLYDTYYSTVGSRTIIVGYDRRFMAEDFARAVADAVTAVGFDVLLSEGYAPTPAFSWAAKQLNALGALVITASHNPGAYLGLKVKGYFGGSVSPEVTKDVEALLSTGVPPAATPGKLEKFDPWPSYTQGLEGKVDIAKIRKAIASGELTVFADVMHGAAATGLGRLLGERVQEINSDRDPLFGGGAPEPLPKYLSLLFETIRNHRETNPSSLSVGLVFDGDCDRIAAVDGNANFLSSQILIPILIDHLTQRRNFTGEIVKTVSGSDLIPKVAALHNLSIFETAVGYKYIADRMLAAPVLLGGEESGGIGYGSHIPERDALLSALYVLEAIVESGLDLGDYYRQLQEQTGFSSAYDRIDLPLASMDVRARLLQQLQSQPLTEIAGKAVIDCNTIDGYKYRLVDNSWLMIRFSGTEPVLRLYCEASTLKQVHQTLAWAKHWAE

SEQ ID NO: 13571 - protein, 509 aa, Nostoc sp. PCC 7120
MSNSELDRVIVRPVDEYNQKLVAYVHPPDWVNPQPADNYDLVVIGAGTAGLVVAAGAAGLGLGLKVALIEKHLMGGDCLNVGCVPSKTIIRSSRVVGEIWNGKNLGVNIPSQIDIDFPAVMARMRRVRAGISHNDSAERFASLGVDVFLGSGRFASSNTVEVAGKTLKFKKAVIATGARATKPAIIGIEQAGYLTNETVFSLIQRPEKLAVIGGGPIGCELAQAFRRLGSEVVLIHSGSHVLNKEDNDAAQIVQQTLIKEGIRLVLNAKVEEVVTVTEGKRLYFSTNGHRDSVTVDEILVGAGRSPNVEGLNLEAVGVKYDKRRGVEVNDYLQTTNPKIYAAGDICMDWKFTHAADAAARIVIKNTLFSPFGLGRSRLSSLVMPWVTYTDPEVAHVGLYESQDVETIKIPFSSVDRAIADGQEDGFLKIHHKKGSDEIVGATIVASHAGEMISEVTTAIVNKIGLNKLSNVIHPYPTQAEAIKKAADTYRRTLLTPRTKKLLGFLTKFS

SEQ ID NO: 13572 - protein, 298 aa, Nostoc sp. PCC 7120
MQANVFTNVILPLALAIIMLGMGLSLQIEDFKRITKYPKAVSIGSATQLILLPIMGFLVAKVVPMQPEIAVGLVILSLCPGGPSSNMITYLAQGDVALSVTLTVVSSMVTIFTIPIFANLALQHFLGQTAAIALPIGSTMLQIFLITIVPIGLGMYIKRIFPATALRLEKATNRLAIAFLALIILILVIREWNRIPGFIVQVGVGVVILNILAMLSGWCMSKFFKLNIPQQICVAIEVGIQNGTLAIAITAGLLQNEDMAIPAAIYSLFMNLTAFAAIYYGRKLSATNSVSNHLVGKV

SEQ ID NO: 13573 - protein, 476 aa, Nostoc sp. PCC 7120
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKNAGGLNAKQLHEVFTEWNTTDELNSFLIEITANIFPYIDPETKLPLVDLIVDAAGQKGTGRWTVQTALELGVSIPTITAAVNARIISSIRDERIAASKQLTGPSGKYDGDTKEFINKVRDALYCSKICSYAQGMALLSTASATFNWNLNLSEMARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 13574 - protein, 152 aa, Nostoc sp. PCC 7120
MADFLPSPEQEDNRSGFEPELGGFLRDAPERSGFEPELGGILRQKGVYVDEITCIGCKHCAHVARNTFYIEPDYGRSRVIRQDGDAEEVIQEAIDTCPVDCIHWVDYTELKNLEEDRKFQVIPVVGYPVDHAVATTEKRRRKQKSKNKKSRY

SEQ ID NO: 13575 - protein, 387 aa, Nostoc sp. PCC 7120
MEIQLGRGKTARRAYGIDEIALVPGNRTLDPSLADTRWKIGNIEREIPIIASAMDGVVDVKMAVRLSQLGALGVINLEGIQTRYADPEPILDRISSVGKDEFVSLMQELYAEPIKPELITKRIQEIKEQGGIAAVSATPVGASKYGEVVAKAGADLFFIQATVVSTAHLSPESVVPLDLAEFCRSMPIPVILGNCVTYEVTLNLLKAGAAAVLVGIGPGAACTSRGVLGVGVPQATAIADCAAARDDYYQETGNYIPIIADGGLITGGDICKCIACGADGVMIGSPFARAAEAPGRGFHWGMATPSPVLPRGTRIRVGTTGTLEQILTGPAGLDDGTHNLLGALKTSMGTLGAKDIKEMQQVEVVIAPSLLTEGKVYQKAQQLGMGK

SEQ ID NO: 13576 - protein, 260 aa, Nostoc sp. PCC 7120
MTQPLIQLKGVSKSFGNNQVLDNVDLTIYRGEALGIIGPSGTGKSTILRIIAGLITPDAGEIYVQGVKREGLIEDGQDPVGIGMVFQQAALFDSLTVEENVGFLLYQHSQLERSRIRELVAEKLEMVGLRGIGHLYPSELSGGMRKRVSFARAIMSNPDNPAEGPEVLLYDEPTAGLDPIASTVIEDLIRDLQCTHGVCSTYAIVTHQDSTIRRTSDRLVFLYQGQVPWEGTVSDIDSTDDPLINQFVSGSVQGPIQVVG

SEQ ID NO: 13577 - protein, 315 aa, Nostoc sp. PCC 7120
MMPTATDFKDYYAVLGVSKTATPEEIKRAYRKLARKYHPDLNPGDKDAEAKFKDLNEANEVLSDPEKRQKYDRFGQHWNHPGYTDAPPPSSTNVDTTDFDQYGDFDSFINDLLGRTRRKTSTGGFDDFSGGFRSQAPAPDTEAAIALTFSEAFHGVQKRLQLDEETINVRIPPGAKPGSRIRIKGKGRPSPFSQQRGDLYLTIEVLPHPFFRFEGDNLVCEIPIRPDEAVLGAQISVPTPDGSVTMKIPKGVRSGQSLRLRGKGWTLPKGGRGDLFAKLQMVTPQDLSAIEQEYYEKIQANTSFNPRTQLEEIKL

SEQ ID NO: 13578 - protein, 239 aa, Nostoc sp. PCC 7120
MGIADFLGLIHPAIAVIFVFPLIGIVSNFAWQTRQRRLQTLAGGKSKIPPVVGTEHRRIGEWLSSAVVGISLVGLGYAIAKSIIKNQLWNKNLTQVIFILLMFVLTIASLVFLYQAKQKLWRGVFATLTGVGLVVIGCQDGVFRRTNEWYWSHYYIGIAASLLMIFSVAIVQDIYQDKTHRWRIIHTILNTIALLLFIGQGFTGTRDLLEIPLSWQEPYVYQCNFVQKTCQNSASQEQK

SEQ ID NO: 13579 - protein, 467 aa, Nostoc sp. PCC 7120
MNRQTMPFSKPPSCLNRISQFFRFKQLETNFRTELLAGLTIFITTAPILVVNAHILGNAIFLQQAGDLLEQILVALALCAAVSSFLIGVLTNYPFVLGSATGAAALFTFSIVLGMGMNWRLALTAVLVEGILFTALSVSPLRRQLHNAIPNSLKQAMVIGLGLFLSSIALSGKVASSQVGAGIIVANTATLTSLGTLKQPATLMAIFGILLTILLTVRKVKGAFLFVIFGTAALGWLTGVAPRPKGILALPQLPQDLIGQALVGVQYLSWSQLGNFVAVVFVLLFMSLSDAMSFNVLGRQIDCMQPDGELYRSKQALLSNALGTVFGAIVGSTPVMPYLVAASGIFEGGRSGFVAIVVGLLFLISTLFTPLFAAIPAFATAPIPLMIGVLMMSGVRLINWNDLAEAIPAFVVILITPLTFSIADGMAAGFIAHAVATVAQRNRQGTRSSLVLAGIAVAYFTLITIQA

SEQ ID NO: 13580 - protein, 468 aa, Abatia parviflora
KASVGFKAGVKDYKLTYYTPDYETKDTDILAAFRVTPQPGVPPEEAGAAVAAESSTGTWTSVWTDGLTSLDRYKGRCYDIEPVAGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMIKRAVFARELGVPIVMHDYLTGGFTANTTLSHYCRDNGLLLHIHRAMHAVIDRQKNHGMHFRVLAKALRLSGGDHVHSGTVVGKLEGERDITLGFVDLLRDDFVEKDRSRGIFFTQDWVSLPGVLPVASGGIHVWHMPALTEIFGDDSVLQFGGGTLGHPWGNAPGAVANRVALEACVQGRNEGRDLAREGNEIIREASKWSPELAAACEVWKEIKFEFPAMDTL

SEQ ID NO: 13581 - protein, 466 aa, Altingia excelsa
SVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13582 - protein, 466 aa, Casearia sylvestris
SVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHGGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNQIIREASKWSPELAAACEVWKEIKFEFPAMDTL

SEQ ID NO: 13583 - protein, 466 aa, Cucumis sativus
SVGFKAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMVTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13584 - protein, 466 aa, Cucurbita pepo
SVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKAIKFEFEAVDTL

SEQ ID NO: 13585 - protein, 465 aa, Decumaria barbara
VGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 13586 - protein, 471 aa, Fendlera rupicola
  misc_feature (306)..(306): Xaa can be any naturally occurring amino acid
PETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIXFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13587 - protein, 469 aa, Flacourtia jangomas
KASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVKARNEGRDLAREGNEIIREASKWSPELAAACEVWKEIKFEFEAVDKLD

SEQ ID NO: 13588 - protein, 465 aa, Galphimia gracilis
VGFKAGVKDYKLTYYTPDYGTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13589 - protein, 465 aa, Gomortega keule
VGFKAGVKDYKLTYYTPEYEEKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 13590 - protein, 466 aa, Humulus lupulus
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKSQSETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 13591 - protein, 467 aa, Hypericum perforatum
GVGFKAGVKEYKLTYYTPDYETKDTDILAAFRVTPQPGVPPEEAGAAVAAESSTGTWTTVWTDGLTSLDRYKGRCYHIERVPGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRERFLFCAEAIYKAQAETGEIKGHYLNATAGTCEEMMKRAVFARELGVPIVMHDYLTGGFTANTSLAHYCRDNGLLLHIHRVMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIRAAGKWSPELGAACEIWKEIKFEFEAMDTLD

SEQ ID NO: 13592 - protein, 468 aa, Idesia polycarpa
KAGVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKLNFQAMDTC

SEQ ID NO: 13593 - protein, 475 aa, Juglans nigra
MSPQTETKASVGFKAGVKDYKLTYYTPEYQTKDTDILAAFRVSPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13594 - protein, 468 aa, Kiggelaria africana
KASFGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13595 - protein, 475 aa, Magnolia tripetala
MSPKTETKASVGFKAGVKEYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASQGNEIIREASKWSPELAAACEVWKEIKFEFKAVDTL

SEQ ID NO: 13596 - protein, 466 aa, Malesherbia linearifolia
SVGFKAGVKDYKLTYYTPEYNPKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 13597 - protein, 469 aa, Ochroma pyramidale
KASVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGAPIIMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 13598 - protein, 465 aa, Pilea pumila
VGFKAGVKDYKLTYYTPEYETKDTDILAAFRVTPQPGVPPEEAGAAVAAESSTGTWTTVWTDGLTTLDRYKGRCYHIEPVPGEESQFIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGAPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 13599 - protein, 475 aa, Populus tremuloides
MSPQTETKTGVGFKAGVKEYKLNYYTPEYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13600 - protein, 466 aa, Quiina pteridophylla
SVGFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVFECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 13601 - protein, 469 aa, Takhtajania perrieri
KASVGFKAGVKDYKLTYYTPDYETKDTDILAAFRVTPQPGVPPEEAGAAVAAESSTGTWTTVWTDGLTSLDRYKGRCYHIEPVAGEEDQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFKAVDTLD

SEQ ID NO: 13602 - protein, 466 aa, Tetrameles nudiflora
SVGFKAGVKDYKLTYYTPEYQTKDTDILAAFRVTPQPGVPPEERGAAVAAESSTGTWTTVWTDGLTSLDRYKGRCYHIEPVAGEESQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIIMHDYLTGGFTANTSLAHYCRDNGLLLHIHRAMHAVIDRQKNHGMHFRVLAKALRLSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13603 - protein, 469 aa, Pardanthopsis dichotoma
  misc_feature (432)..(432): Xaa can be any naturally occurring amino acid
KASVGFKAGVKDYRLTYYTPDYETKDTDILAAFRVTPQPGVPAEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDYIEKDRSRGIFFTQDWVSMPGVLPVASGGIHVWHMPALTEIFGDDSVLQFGGGTLGHPWGNAPGAVANRVALEACVQARNEGRDLAXEGNEIIREACSWSPELAAACEIWKEIVFNFAAVDVLD

SEQ ID NO: 13604 - protein, 364 aa, Nostoc sp. PCC 7120
MNSFPKTLSSENFSSSQYNNRKRYNLFVSANVTQALGNVPIVQLGNISRVCIESECLLKLESCNPGGSIKEKNAVYLVKRAEEEGLLVPGGTIIESSSGNFGVGLAMVGAVRGYRVIIVVDAKTAPPFRRMLKAYGAELVDVPLHEADESGSMQKARMKRAHELTATIPNAWYPCQHLNPWNTEAHSYYTAREIEAHFAGELDAVVVGVSTAGQIMGIARYLLPRFPKIRIVGVDVVGSVIMGTPAKPYKMTGIGLSFFPPNLDISMLDRAYVIPEDMAYSVCHALASREGLLLGASTGAIVAGGLHLARSLGAGARILMINPDRGDRYLETVYDSDWLDHHGFTLKQGEHLDDAIASLTPLYF

SEQ ID NO: 13605 - protein, 1063 aa, Saccharomyces cerevisiae
MDDYHVNTAFSMGRGNQQDDGNSERNSMHTQPSTMAPATLRMMGKSPQQQQQQNTPLMPPADIKYANNGNSHQAEQKERQVELEGKSRENAPKPNTTSQSRVSSSQGMPKQFHRKSLGDWEFVETVGAGSMGKVKLAKHRYTNEVCAVKIVNRATKAFLHKEQMLPPPKNEQDVLERQKKLEKEISRDKRTIREASLGQILYHPHICRLFEMCTLSNHFYMLFEYVSGGQLLDYIIQHGSIREHQARKFARGIASALIYLHANNIVHRDLKIENIMISDSSEIKIIDFGLSNIYDSRKQLHTFCGSLYFAAPELLKANPYTGPEVDVWSFGVVLFVLVCGKVPFDDENSSVLHEKIKQGKVEYPQHLSIEVISLLSKMLVVDPKRRATLKQVVEHHWMVRGFNGPPPSYLPKRVPLTIEMLDINVLKEMYRLEFIDDVEETRSVLVSIITDPHYGLLSRQYWTLAAKMNAESSDNGNAPNITESFEDPTRAYHPMISIYYLTSEMLDRKHAKIRNQQQRQSHENIEKLSEIPESVKQRDVEVNTTAMKSEPEATLATKDTSVPFTPKNSDGTEPPLHVLIPPRLAMPEQAHTSPTSRKSSDNQRREMEYALSPTPQGNDYQQFRVPSTTGDPSEKAKFGNIFRKLSQRRKKTIEQTSVNSNNSINKPVQKTHSRAVSDFVPGFAKPSYDSNYTMNEPVKTNDSRGGNKGDFPALPADRENMVEKQREKQIEEDIMKLHDINKQNNEVAKGSGREAYAAQKFEGSDDDENHPLPPLNVAKGRKLHPSARAKSVGHARRESLKYMRPPMPSSAYPQQELIDTGFLESSDDNKSDSLGNVTSQTNDSVSVHSVNAHINSPSVEKELTDEEILQEASRAPAGSMPSIDFPRSLFLKGFFSVQTTSSKPLPIVRYKIMFVLRKMINEFKEVKGGFVCMQRFSSNNVAAKREGTPRSIMPLSHHESIRRQGSNKYSPSSPLATNTHQRNSSITETYGDDKHSGTSLENIHQQGDGSEGMTTTEKEPIKFEIHIVKVRIVGLAGVHFKKISGNTWLYKELASSILKELKL

SEQ ID NO: 13606 - protein, 1153 aa, Saccharomyces cerevisiae
MPNPNTADYLVNPNFRTSKGGSLSPTPEAFNDTRVAAPATLRMMGKQSGPRNDQQQAPLMPPADIKQGKEQAAQRQNDASRPNGAVELRQFHRRSLGDWEFLETVGAGSMGKVKLVKHRQTKEICVIKIVNRASKAYLHKQHSLPSPKNESEILERQKRLEKEIARDKRTVREASLGQILYHPHICRLFEMCTMSNHFYMLFEYVSGGQLLDYIIHDGSLKEHHARKFARGIASALQYLHANNIVHRDLKIENIMISSSGEIKIIDFGLSNIFDYRKQLHTFCGSLYFAAPELLKAQPYTGPEVDIWSFGIVLYVLVCGKVPFDDENSSILHEKIKKGKVDYPSHLSIEVISLLTRMIVVDPLRRATLKNVVEHPWMNRGYDFKAPSYVPNRVPLTPEMIDSQVLKEMYRLEFIDDIEDTRRSLIRLVTEKEYIQLSQEYWDKLSNAKGLSSSLNNNYLNSTAQQTLIQNHITSNPSQSGYNEPDSNFEDPTLAYHPLLSIYHLVSEMVARKLAKLQRRQALALQAQAQQRQQQQQVALGTKVALNNNSPDIMTKMRSPQKEVVPNPGIFQVPAIGTSGTSNNTNTSNKPPLHVMVPPKLTIPEQAHTSPTSRKSSDIHTELNGVLKSTPVPVSGEYQQRSASPVVGEHQEKNTIGGIFRRISQSGQSQHPTRQSGTYSSKENLQHICQNQMKFPSKYRKAIVVLYQTYIPSARRYPSYVPNSVDVKQKPAKNTTIAPPIRSVSQKQNSDLPALPQKRQLIVQKQRQKLLQENLDKLQINDNDNNNVNAVVDGINNDNSDHYLSVPLSVPKGRKLHPSARAKSVGHARRESLKFTRPPIPAALPPSDMTNDNGFLGEANKERYNPVSSNFSTVPEDSTTYSNDTNNRLTSVYSQELTEKQILEEASKAPPGSMPSIDYPKSMFLKGFFSVQTTSSKPLPIVRHNIISVLTRMNIDFKEVKGGFICVQQRPSIETAAVPVITTTGVGLDSGKAMDLQNSLDSQLSSSYHSTASSASRNSSIKRQGSYKRGQNNIPLTPLTTNSIHQRKTSIPMSPNYGNQSNGTSGELSSMSLDYVQQQDDILTTSRAQNINNVNGQTEQTNTSGIKERPPIKFEIHIVKVRIVGLAGVHFKKVSGNTWLYKELASYILKELNL

SEQ ID NO: 13607 - protein, 1499 aa, Candida albicans
MSTANTSLSQQLDENPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVGKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGASQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 13608 - protein, 208 aa, Saccharomyces cerevisiae
MSLSSKLSVQDLDLKDKRVFIRVDFNVPLDGKKITSNQRIVAALPTIKYVLEHHPRYVVLASHLGRPNGERHEKYSLAPVAKELQSLLGKDVTFLNDCVGPEVEAAVKASAPGSVILLENLCYHIEEEGSRKVDGQKVKASKEDVQQFRHELSSLADVYINDAFGTAHRAHSSMVGFDLPQRAAGFLLEKELKYFGKALENPTRPFLA

SEQ ID NO: 13609 - protein, 135 aa, Saccharomyces cerevisiae
VDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 13610 - protein, 503 aa, Pisum sativum
MAITVSSRQLFIDGEWRVPILNKRIPNINPSTENIIGDIPAATKEDVDLAVDAAKRAISRKNGRDWSAASGSLRARYLRAIAAKIKEKKDELGKLESIDCGKPLEEALADLDDVVACFEYYAGLAEELDSKQKAPISLPMDTFKSYILKEPIGVVALITPWNYPFLMATWKIAPALAAGCAAILKPSELASVTCLELGEICKEVGLPRGVLNIVTGLGHEAGASLASHPDVDKISFTGSSATGSKIMTTAAQLVKPVSLELGGKSPIVVFEDVDLDKVAEWTGFGCFFTNGQICSATSRLIVHESIAVEFVDKLVKWAENIKISDPLEEGCRLGPIVSEAQYKKVLNCISSAKSEGATILTGGRRPEHLKKGYFVEPTIITDVTTSMQIWREEVFGPVLAVKTFSTEEEAINLANDTHYGLGSAVMSNDLERCERLSKALQAGIVWINCAQPSFIQAPWGGIKRSGFGRELGEWGLENYLSVKQVTRYTSDEPWGWYQPPSKL

SEQ ID NO: 13611 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 13612 - protein, 469 aa, Dioscorea elephantipes
KASVGFKAGVKDYKLTYYTPDYETKDTDILAAFRVSPQPGVPPEEAGAAVAAESSTGTWTTVWTDGLTSLDRYKGRCYHIESVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFKPVDTLD

SEQ ID NO: 13613 - protein, 469 aa, Dioscorea communis
KASVGFKAGVKDYKLTYYTPDYETKNTDILAAFRVSPQPGVPPEEAGAAVAAESSTGTWTTVWTDGLTSLDRYKGRCYHIESVVGEENQYIAYVAYPLDLFEEGSVTNMFTSIVGNVFGFKALRALRLEDLRIPTAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFKPVDTLD

SEQ ID NO: 13614 - protein, 318 aa, Carica papaya
MENFPVIDLSKLNGEERALTMELIHDACENWGFFELVNHGISHDLMDTVERLTKEHYMKCMEQRFKEMVESNGLEAVQSEINDMDWESTFFLRHLPASNMHEIPDLEDDYRKAMKEFAVGLQKLAEQMLDLLCENLGLQKGYLKKVFYGSKGPNFGTKVSNYPPCPKPDLIEGLRAHTDAGGIILLFQDGKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 13615 - protein, 294 aa, Helianthus annuus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKTGLDLLRKMLCLDPSKRITARTALEHEYFKDIGFVP

SEQ ID NO: 13616 - protein, 164 aa, Datura ferox
FSSKLPWKETLSFRYSAQKDSSHIVEEYFQRTLGESFNHLGNTYQEYCNSMSTLSLGIMELLGMSLGVEKNHFKEFFEENESIMRLNYYPPCQKPELTLGTGPHCDPTSLTILHQDCVGGLQVFVDNEWRSISPNFNAFVVNIGDTFMALSNGRYKSCLHRAVV

SEQ ID NO: 13617 - protein, 341 aa, Lycopersicon esculentum
EMKKGLFGVMHYLMPKRQILSLHSGCNMGKEGDVALFFGLSGTGKTTLSTDHNRYLIGDDEHCWSDHGVSNIEGGCYAKCIDLAREKEPDIWNAIKFGTVLENVVFEEHTREVDYTDKFVTENTRAAYPIEYIPNAKIPCVGPHPKNVILLACDAFGVLPPVSKLNLAQTMYHFISGYTALVAGTEDGIKEPTATFSACFGAAFIMLHPTKYAAMLAEKMLKHGATGWLVNTGWSGGSYGSGSRIKLAYTRKNIDAIHSGDLLKAEYKKTEVFGLEIPTALEGVPSEILDPVNTWPDKKAHKDTLLKLGGLFRKNFEVFTNYKIGSDSNLTEEILAAGPNF

SEQ ID NO: 13618 - protein, 332 aa, Nostoc sp. PCC 7120
MKPKVVITNWVHPEVIELLKPSCEVIANPSKEALSREEILQRAKDAEALMVFMPDTIDEAFLRECPKLKIIAAALKGYDNFDVAACTHRGIWFTIVPSLLSAPTAEITIGLLIGLGRQMLEGDRFIRTGKFTGWRPQFYSLGLANRTLGIVGMGALGKAIAGRLAGFEMQLLYSDPVALPPEQEATGNISRVPFETLIESSDFVVLVVPLQPATLHLINANTLAKMKPGSFLINPCRGSVVDEQAVCKALESGHLAGYAADVFEMEDWYRSDRPHNIPQPLLENTKQTFFTPHIGSAVDELRHNIALEAAQNILQALQGQKPQGAVNYLRES

SEQ ID NO: 13619 - protein, 245 aa, Nostoc sp. PCC 7120
MYVYFRADSMIFLPQPSSYLDTQEIKKLKSGGETKISAVHLVNPTAKYTIIYAHGNAEDLGEIRQFLEQLRDLGFNVLAYDYRGYGTSAGRPTENNAYQDIDAAYNYLTKDLKILPKNIIVFGRSVGGGSAVDLAARQPVGGLIIESTFTSAFQVVVPIKILPFDKFNNLEKIKKVNCPVLIMHGQADEIIPFTHAQKLYAASPSPKLKLWVDNASHNDFYGVAGQRYKNILREFTNLVSSSQKS

SEQ ID NO: 13620 - protein, 361 aa, Mesembryanthemum crystallinum
MANSAPENVHPQKAFGWAARDTSGTLSPLKFSRRATGEQDVTFKVLYCGICHSDLHYIKNEWGNAVYPAIPGHEIVGVVTEVGNKVQNFKVGDKVGVGCMVGSCRSCESCENHLENYCPKMILTYGSTYYDGTLTYGGYSDIMVVEEHFAVRIPDNMALDATAPLLCAGVTVYSPLKHFELDKPGLHIGVVGLGGLGHMAVKFGKAFGAKVTVISTSPNKKDEAVNRLGADSFVVSREPEQMQSAMGTLDGIIDTVSAAHPLLPLLGLLKSQGKMIMVGVPDKPLELPVFPLLQGRKILAGSCIGGMKETQEMIDFAAKHDIKSDIEVVPMDYVNTAMERLLKGDVRYRFVIDVANTLKAE

SEQ ID NO: 13621 - protein, 339 aa, Pichia pastoris
GCVKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQPP

SEQ ID NO: 13622 - protein, 467 aa, Bradyrhizobium sp. HW13
MSIVNIAEVIESQTLNRKVVSLLLLSFLIMLCDGYDLQTISFASPSIVADWGIEKSAFGFVFTAGALGIMVGGFLFGSLADRIGRRPSFIIGTLLFSVMTLSTVLATTVTHLAVFRFIAGLGIGGVTPICFALNVEYVPKRFRATVVAVVMIGYMIGTGIGGILAAWLVPQHGWHVLFYIGGVAPLALMPLLVFALPESIKYLLLSNEHSKSVPLLVNALCPAAGATSDTRFVLDDTEDQAKLGSWKEIILSLFKGRLRRVTPVLWISFIASNMTVFLLAFWIPLITVSTGRSASLAAIGLTLYSLGGAFGGLLASRIVDMRGVAAVALIPLIASAVIIATGALEFSDAGFLTMMGVIGFFVFGGHLALMSVTGMFYPNSNRASGAGWALSVGKLGAIFGPALAGFVIASHPPLIDLFLIAAAPLPIVALGFFMLGRLGGAQAVATRAEDGGQANVEKPVLVHGSAS

SEQ ID NO: 13623 - protein, 256 aa, Moritella marina
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 13624 - protein, 473 aa, Lactobacillus acidophilus
MTKTLPKDFIFGGATAAYQAEGATKTDGKGRVAWDKFLEENFWYKGDPASDFYHNYVEDLELAEKFGGNVIRISIAWSRIFPNGDGEVKPNGVDFYHKLFAECDARHVEPFVTLHHFDTPEGLHEDGDFLTHEKMDDFVEYADYCFKEFPEVKYWITINEIRSVAVDQYIIGNFPPADTFGFDKMFQTHHNQMVGHARAVKLFKHDGSKGEIGIVHALQTNYPFNESNPADIGAAELEDLLDNKFLVDGTFVGKYPQETMEAVKDILAANHGGEFNIEDEFKAIDAAKDVQDFVGVDYYLSEWMRAYDGKSEITHNGTGDKGTSKVQVKGVGEEKLPDGIETTDWDWLIYPQGLYDKIMRVKNDYPNIHKVYITENGIGFKDTVPDNEETDKTVHDDARIDYVKQHLEVIADAIADGANVKGYFIWSLMDVFTWTNGYTKRYGLFYVDFDTQDRYPSKTADWFKNLAETHIIE

SEQ ID NO: 13625 - protein, 311 aa, Yarrowia lipolytica
KLRVDYNRLKKEWWVQEDKERDDFWRDQLSRIEKDVHRTDRNITFFAECDAKKDGDDDNYDKDEFGFSSQINSNIHLIQLLDMLITYNQHNKNLGYVQGMSDLLSPLYVVLQDDTLAFWAFSAFMERMERNYLRDQSGMRNQLLCLDHLVQFMLPSLYKHLEKTESTNLFFFFRMLLVWFKRELLWDDVLRLWEVLWTDYLSSQFVLFVCLAILDKHKDVMIDHLAGFDEILKYMNELSMTIDLDELLVRAELLFYRFRRTVELIDRKNEDRRNSADGSEPVSITEDLRELLSRKVIVVREGERPEGVMGG

SEQ ID NO: 13626 - protein, 417 aa, Yarrowia lipolytica
MSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 13627 - protein, 437 aa, Brassica nigra
GVDFFHRYKEDIQLMKNLNTDAFRMSIAWPRIFPHGRKEKGVSQAGVQFYHDLIDELKRNGITPFVTVFHWDTPQDLEDEYGGFLSERIVKDFREYADFVFQEYGGKVKHWITFNEPWVFSHAGYDVGKKAPGRCSKYVKEECHDGRSGFEAYLVTHNLLNSHAEAVEAFRQCEKCKGGKIGIAHSPAWFEPHDLADSQDGASIDRALDFILGWHLDTTMYGDYPQIMKDIVGHRLPKFTEAQKAKLKNSADFVGLNYYTSMFSNHLEKPDPAKPRWMQDSLINWETKNAYNYSIGSKPITGALPVFARGFRSLLKYIKDKYGNPEIMIMENGYGEELGAADSIEVGTADHNRKYYLQRHLLSMNEAICIDKVNVTGYFVWSLLDNFEWQDGYKNRFGLYYIDFKNNLTRYEKESGRYYKDFLSQGVRPSMINRDEL

SEQ ID NO: 13628 - protein, 313 aa, Medicago truncatula
MDSFPIINLENLNGDERKATMEKIKDACENWGFFELVNHGIPHDLMDTVERLTKEHYRKCMEQRFKELVSSKGLEAVQTEVKDMDWESTFHLRHLPESNISEIPDLSDEYRKSMKEFALKLETLAEELLDLLCENLGLEKGYLKKALYGSKGPTFGTKVANYPPCPKPDLVKGLRAHTDAGGIILLFQDDKVSGLQLLKDGNWVDVPPMHHSIVINLGDQLEVITNGKYKSVEHRVVAQTDGTRMSIASFYNPGSDAVIYPAPTLIEENNEIYPKFVFEDYMNLYARLKFQAKEPRFEAFKESNVNLGPIATV

SEQ ID NO: 13629 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAAITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 13630 - protein, 405 aa, Escherichia coli
STAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 13631 - protein, 513 aa, Vicia sativa
MELETLISWLLFSTSLFWFLFLATKTKSKPPKTPSSTTNTPIPKSYPIFGSAFSLLANFHRRIQWTSDILQTIPSSTFVLHRPFGARQVFTAQPAVVQHILRTNFTCYGKGLTFYQSINDFLGDGIFNADGESWKFQRQISSHEFNTRSLRKFVETVVDVELSDRLVPVLSQASNSQTTLDFQDILQRLTFDNICMIAFGYDPEYLLPSLPEIPFAKAFDESSQLSIERLNALIPLLWKVKRFLNIGVERQLKEAVAEVRGLATKIVKNKKKELKEKALQSESESVDLLSRFLSSGHSDESFVTDMVISIILAGRDTTSAALTWFFWLLSKHSHVENEILKEITGKSETVGYDEVKDMVYTHAALCESMRLYPPLPVDTKVAVHDDVLPDGTLVKKGWRVTYHIYAMGRSEKIWGPDWAEFRPERWLSRDEVGKWSFVGIDYYSYPVFQAGPRVCIGKEMAFLQMKRVVAGIMGRFRVVPAMVEGIEPEYTAHFTSVMKGGFPVKIEKRSPLV

SEQ ID NO: 13632 - protein, 319 aa, Prunus mume
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEKGYLKKAFYGTNGPTFGTKVSNYPPCPNPELIKGLRAHTDAGGLILLFQDDKVSGLQLLKDGQWIDVPPMRHSIVINLGDQLEVITNGKYRSVEHRVIAQTDGTRMSIASFYNPGSDAVIYPAPTLVEKEAEEKNQVYPKFVFEDYMKLYAGLKFQPKEPRFEAMKAVETNISLVPIATA

SEQ ID NO: 13633 - protein, 466 aa, Nandina domestica
  misc_feature (122)..(123): Xaa can be any naturally occurring amino acid
SVGFKAGVKDYKLNYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALXXLRLEDLRIPTSYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAASEVWKEIKFEFEAMDTL

SEQ ID NO: 13634 - protein, 465 aa, Idesia polycarpa
VGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 13635 - protein, 181 aa, Antirrhinum majus
MAAKVSSDPLVIGRVIGDVVDHFTSTVKMSVIYNSNNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 13636 - protein, 431 aa, Mycoplasma genitalium
MSDKLLTIDLSHVYGFDKEIIFKKYQKKVDQIHQDFLAHKLADGHMTGWYDQPDQNHQFLLKTINQIDKKFKSLKVTDIVYVGIGGSFTGIKTVLDFLKPKQRTGLKIHFVPDLSAFQAASVIKEIKNKSWALITTSKSGRTLEPALNFRIFRNLLNKRYGNKHYQRVVVITDEKKGLLTKMASNHGYQKLVIDSNIGGRFSTLSPAGLLLAKLFGHDPKAILKGTLQAKKDLQTTSLENNSAYLYAVVRHWLYTTKKFKIEVCIAYHSLYEYLLLQHRQLFGESEGKNDKSLFPTFSIFTVDLHSMGQLYQEGEKVFFETVIDVKNPLVNINLPPSDFDNDDELDFLLDKSLNEISDVAIDSVIKAHYQANVSIIKLTLKEQSAFMFGYFYFWLSVATVMSGSLLGHNVFNQPGVEVYKKLMFEKLRSGH

SEQ ID NO: 13637 - protein, 204 aa, Arabidopsis thaliana
MEKSNDHDKASHGASGGGATEKWEETSLGIRTAETMLRLAPVGLCVAALVVMLKDSETNEFGSISYSNLTAFRYLVHANGICAGYSLLSAAIAAMPRSSSTMPRVWTFFCLDQLLTYLVLAAGAVSAEVLYLAYNGDSAITWSDACSSYGGFCHRATASVIITFFVVCFYIVLSLISSYKLFTRFDPPSIVDSAKNLEVAVFGS

SEQ ID NO: 13638 - protein, 124 aa, secondary symbiont of Thelaxes suberi
QCSQFINRYPYWKIVYTESTAAAMKKVAKLNSPKSAALGSEAGGALYGLQVLKHNLANQQQNVTRFIVLARKAINVSEQVPAKTTLIMATGQQSGALVEALLVLRDNDIIMTKLESRPINGNPW

SEQ ID NO: 13639 - protein, 253 aa, Buchnera aphidicola (Macrosiphum rosae)
AGEYADRNFQKCITNECSTFEEVILSVENNESDYAVLPIENTCSGSIHEVFNLLKNTNLFIIGEINIFINHCLLALEKIELNKIKTVYSHPQPFQQCSNFIKQFPEWEIKYTKSTADAMKKITKYHEKTNAALGSEIGSKIYGLKILTKNLANKEKNITRFIILNRNSIKISEKIPTKTTLILSTGQESGALAKVLLILKENQLIMKKLTSQPLYKNPWEEMFCIDIQVNVSSVLMQDVLKKIKKITKFIKIL

SEQ ID NO: 13640 - protein, 253 aa, Buchnera aphidicola (Rhopalosiphum padi)
ASQYAERNFKTCIENACLNFNEVIHSVENNQADYAVLPIENSCSGFINEIFDILKKTNLLIVGEINILINHCLLAIKKIELNKIKVIYSHPQPFQQCSYFINQFPNWKIQYTNSTADAMKKIAKCYIETNAALGSELGSKIYGLEILSKNLANKKKNITRFILLSRKPIVSSSKIPTKTTLIFNTGQESGALAEVLLILKKKKLIMKKLTSQNIYKNPWEEMFYIDIQGNLSSSLMQETLEQIQKITKFIKIL

SEQ ID NO: 13641 - protein, 124 aa, secondary symbiont of Tetraneura caerulescens
QCSQFLNRFPHWKIEYTESTAAAMEKVAAMNSPTVAAIGSEAGGELYQLKVLERHLANQQQNITRFIILARKAVEVSSQVPAKTTLIMATGQQAGALVEALLVLRQHNLIMSKLESRPINGNPW

SEQ ID NO: 13642 - protein, 124 aa, secondary symbiont of Tuberolachnus salignus
QCTNFLANYPNWKIVYCDSTSSAMDTVAKHNQPNVAAIGNKDGGELYGLQVLEHNFANQKENITRFIILARKAVEVSDQIPAKTTILMKTGQQAGALVDALLILRNHDIVMTKLESRPIHGNPW

SEQ ID NO: 13643 - protein, 124 aa, secondary symbiont type 1 of Eulachnus pallidus
QCSQFINRYSHWKIEYCESTSAAMEKVAQANSPLVAALGNEAGGALYGLQVLERNLANQTQNITRFIVLARKAVEVTDQVPAKTTLLIATGQQAGALVEALLVLRNHNLIMTKLESRPINGNPW

SEQ ID NO: 13644 - protein, 167 aa, Nicotiana tabacum
VPLEDFGHGHPDPNLTYAKDLVNILYGENGPDFGAASDGDGDRNMILGRRFFVTPSDSVAIIAANAQDAIPYFQSGPKGLARSMPTSGSLDRVAQKLNLPFYEVPTGWKFFGNLMDAGKLSICGEESFGTGSDHIREKDGIWAVLAWLSILAYRNKDKRSGEILVSV

SEQ ID NO: 13645 - protein, 433 aa, Escherichia coli
MMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 13646 - protein, 192 aa, Escherichia coli
MHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 13647 - protein, 481 aa, Ralstonia solanacearum
MASPVEPDGRRMRAHSAVSFDLIVIGAGSAGLAAARRAAQLGARTLLIDRAEVGGTGVNRGCMPKKLLGYGAAWSQSASRCLHTAAAHGRDAWQDAAARIRTEVGRLHGVYRAHLAEAGVQWLAGSASLRGRGALRLLTDAGKRTMRARQIVLATGARPQPLPVPGAELACTPEDVLTWDALPASLAIVGGGVIAVEMASTLVRFGVRVTLLVRDPRVLPDFDAALSEAAFRALAAHGVDVVPDADVVRVERDAVNGDGVAVYVAGPDGTAARVVRAQRVMAAIGRAPATDGLGLEAAGVTLDARGHIAVDRHFRTRARGVHAIGDVSGSPQLTPVAVAQGRYVAERLFGKGAKLPDMEHVPMAVFCEPAIAAVGLTEAQARERWPDRPERDARPVAERIDVVERRFVSLEQRFAGTGAESLIKLVCNARSGRVLGAHVMDNAAPEIVQALAVAVRMGVRLKHLRSTVGLHPTVAEELLCI

SEQ ID NO: 13648 - protein, 497 aa, Ralstonia solanacearum
MTRTDLPPAPITLNDPALWRTQAFLAGAWTDADDGSTRDVTDPATGRVIGTVPAMGAAETRRAIEAAQAAQRAWRKVTARERARILRKLADLMLEHQQDLARILTAEQGKPLPEATGEIAYAASFIEWFAEEARRVYGDTIPAPQGDRRIVVNKEPIGVTAAITPWNFPIAMMTRKVGPALAAGCAMVVKPALETPYSALAFAELAARAGVPAGLLSIVTGDAQGIGGELTANPVVRKLSFTGSTAVGRLLMRQCADDVKKLSLELGGNAPFIVFDDADLDAAVEGAMVAKYRNAGQTCVCANRFYVQRGIYDAFAARLSEAVRALRVGNGAEPGVQQGPLIHQRAMDKVRAHVDNAVAQGARVLVGGKPHALSAQGGAFFEPTVIVDARPGMLVAHEETFGPLAALIPFDTEDEAVAAANDTEFGLAAYFYTRDLGRAWRVSEALESGMVGVNTGLISTAEAPFGGVKQSGLGREGSKYGIDEYLEIKYVCMAGLG

SEQ ID NO: 13649 - protein, 426 aa, Ralstonia solanacearum
MNARDPQHNAQWNARRLAATPRGVGVMTDRYAEHAENAQFWDVEGKRYIDFAAGIAVVNTGHRHPRLVQAVREQLERFTHTAFQIVPYASYVELAERLNTLTPGAHAKKTAFFSTGAEAVENAIKIARAHTGRPGVIALTGAFHGRTFMGMSLTGKVVPYKTGFGPFPGSIYHVPAPIALHGVSTQDSLDAIGRLFKADIDPRQVAAIIFEPVQGEGGFYQMPADFVRALRALCDEHGIVMIADEVQTGFARTGKLFAMEHTGVLPDLVTMAKGLAGGLPLSAVTGRAEIMDAPAPGGLGGTYAGNPLAVAAAHAVLDIIDEEKLCERSAALGRRLVDALDAAKAGQPRIAEVRGVGAMVAIEFNTPDGKPDADFTRTVQQRALEAGLLLLSCGVYGNVIRFLFPLTIEDAVFEEGLAILKHALEG

SEQ ID NO: 13650 - protein, 450 aa, Ralstonia solanacearum
MTPSTTSVFHRDPRKTLPTAVGGESMMLIDAEGKRYLDASGGAAVSCLGHGHPRVVEAICKQVRALAYAHTSFFTTAVAEELAARLAAAAPGDLGHVYFVSGGSEAIEAALKLARQYFVEIGQPQRQYFIARRQSYHGNTLGALAIGGNAWRREPFLPLLVPAHHVSPCFAYRERRDGETDAQYVQRLADELDAKIVELGADRVAAFIAETVVGATAGAVPPVADYFRKIRAVCDRHGVLLILDEVMSGMGRTGHLFACEEDGVVPDLIAIAKGLGGGYQPIGAMIASDRIYDAITRGSGFFQHGHTYIGHATACAAALEVQKVIAEENLLANVLARGEQLRAALRERFAAHPHVGDVRGRGLFVGVELVADRGTKAPLPPARKTHARVRAEAMQRGLMVYPMGGTIDGQRGDHILLAPPFIATAQDIDAIVARLGDAVEAATANALEAA

SEQ ID NO: 13651 - protein, 408 aa, Ralstonia solanacearum
MTTAATHPSYALETRYGARNYAPLPVMLERGEGVWLFDTAGRRYLDMMSAYSAVSFGHSHPRLVAALVEQAGRLTLTSRAFHNTELGPFLADVCRITRMDRALPMNTGAEAVETAIKAARKWAREVKGTPPDAAEIIVFDNNFHGRTTTIVGFSSHEQYRYGFGPFAAGFRRIPFGDAEALKAAIGPHTGAILIEPIQGEGGIVVPPPGYLKLARDLATQHNALLVCDEVQTGLGRTGDVLASWHEDVQPDLVVLGKALGGGMVPVSAIAGREDVIGVFQPGDHGSTFGGNPLAAHIGRAALALLQEAQLPRHAARLGEAFIAELQSLIGHGVRQVRGRGLMIGLQLDADIDAHDFAAALAGHGVLTKDTYGNVVRLTPPLVIAQQELELARDVIRRTLADWPRRKAA

SEQ ID NO: 13652 - protein, 188 aa, Ralstonia solanacearum
MSDSMQAMVLEGVRAPLKLRNMPMPVPGPGEVRIAVSACGVCRTDLHIVDGEPPNPKPSLIPGHEIVGTVESCGAGVTSPVPGDRIGVPWLGWTCGACPFCLRGHENLCDYLAFTGDTRDGGYAQYVVCDARYCLPIPERYDDAHAAPLLCAGLIGYRTLRMAGDARRLGIYGFGAAAHLITQIAVAE

SEQ ID NO: 13653 - protein, 342 aa, Ralstonia solanacearum
MIGSIFDQLWGARMKKRQLGRSGLQVSALGFGCMGMSFGYGPTALSRNEQIAVIRAAYERGVTLFDTAEAYGPCVNEELVGEAVAPFRSRIVLATKFGFDIRDDRIVGLNSRPEHIRAVAEASLKRLRTDVIDLFYQHRVDPNVPIEEVAGALKDLVAEGKVRHFGLSEAGPRTIRRAHAVHPVSVLQTEYSLWTRDPEGGVLQTCEELGIGFVPWSPLGQGYLTGKVRADTAFDATDLRSTFPRFTPEAMQANQALLAGIRTIADRKGATLAQIALAWLLAQKPWIVPIPGTRSAARLAENLGAADVCLDAADLSEIDAALANAPVGQPRLSDAHLRFIDP

SEQ ID NO: 13654 - protein, 233 aa, Ralstonia solanacearum
MSSPSLAAPALARARDRLARRRTAGVLSRHHLLIIAIAIVIAIIALLLPRTCHAAAGAQAAPAPQPAAAGPCPTALDFRVRRLQDDAPQNLCQYAGRVVLVVNTASYCGYTYQYEGLEALYARFRDKGLTVLGFPSNDFEQEPGTGKQIADFCYNTYGVKFPMFSKTSVVGPAASPLYHWLAQQTGQPPKWNFHKYLLDRSGRVVAVYPSKVEPGDPALIKRIDALLAEPAPR

SEQ ID NO: 13655 - protein, 298 aa, Ralstonia solanacearum
MTRPRHPHVEPSRAGVTGPAAGPLTPARERVIQVRSVTKRYGDVTVLDNIDLDVFRGEVLSIVGGSGSGKTTLLRQVVGLEKPTSGTIHIFGEELTCQVGNELQSMRNRWGMQFQHGALFSALSVIDNVALPMRELRTLPDAFVARVAMLKLQMVGLKASDADKMPADLSGGMIKRVALARALSLEPELVFLDEPTAGLDPRASDDYVALIRELRRELGLTVVMVTHDLDTLVALSDRIAVLADRKVLAAKPVDQIIQIDHPFIKEYFLGERGKRALMALGPEMTEAVAAASLSMQED

SEQ ID NO: 13656 - protein, 267 aa, Ralstonia solanacearum
MTQRVPATAQVFSLLIMAVMHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 13657 - protein, 426 aa, Ralstonia solanacearum
MKKTLLATAIAMGLGVSGAAWADIGNTASGAGDKTQTNTSTITNTTTTTTTDTSSRTSTRNTDNSNQNNDQSQGSNRDNSGWAHAEGYGTAAANNGGTAVSTFSNSFNTSKAIAISRLDGAVSNISVSGIGNVATNTGTANGGSGGRGGYGYGGSGTGGSGGAGGAGGSGGSGGSSGSVTHGSATNGGATAGNGAAGGGASGNAGSGGAGGSSGTLSASLGAGLGGWAGSASAAGGGGGGSGGGAGAAGGDANRHHGSGTATGGAAGAAGGAGGAGGSVSSGASSASGGAGTGTSAATGSSTGGAGAAGGMATNVAGAGGAGGGAANGSATNGSASTTAGNGATGAVGAAGGMGGTGNGGVGNGAVGGAGGAGGAVAVDAGTFNMSNAMTSVGQSAAGVMVANQNSGFASLVQQSINVQANLNVGK

SEQ ID NO: 13658 - protein, 264 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMI

SEQ ID NO: 13659 - protein, 419 aa, Ralstonia solanacearum
MASGKIAAFRDFSAAAMPNVLRLTDLISEGKLAGKRVFIRADLNVPQDDAGNITEDTRIRASVPAIRAALDAGAAVMVTSHLGRPTEGEFKPEDSLAPVAVRLSELLGCEVKLVQNWVDGVDVAPGQVVLLENCRVNKGEKKNSDELAQKMAKLCDVYVNDAFGTAHRAEATTHGIAKFAPIACAGPLLGAELDALGKALGQPARPLVAIVAGSKVSTKLTILKSLADKVDNLIVGGGIANTFMLAAGLKIGKSLAEADLVGDAKAIIDLMAARGASVPIPVDVVCAKEFSATAAATVKDVKDVADDDMILDIGPKTAAQLADQLKASGTIVWNGPVGVFEFDQFGNGTKVLAEAIAASSGFSIAGGGDTLAAIAKYGIADRVGYISTGGGAFLEFLEGKTLPAVEILEQRAQRQEALA

SEQ ID NO: 13660 - protein, 479 aa, Ralstonia solanacearum
MTRATKIVATLGPSSNTLEILTRMIAAGVDVVRLNFSHGTAQDHVARAELVRETARAVGREVGIMADLQGPKIRVGKFESGKITLSPGERFTLDARCELGNQERVGLDYKELPRDVGPGDLLLLNDGLIVLQVERVVGEEIETVVKVGGDLSNNKGINRQGGGLSAPALTAKDMEDIKTAMALGADYIAVSFPKNATDMEMARQLAAVAGAPHSHKTKMIAKIERAEAIRPGVLEEILAASDGIMVARGDLAVEVGNAAVPALQKRMIKLAREANKLAITATQMMESMIVNPVPTRAEVSDVANAVLDGTDAVMLSAETAAGRYPVETIEAMAAICVEAEKSQPVHLDTDFLDQTFSRIDQSIAMGALFTAYHLQVKAIAALTDSGATALWMSRHGINVPIYAITPNVASQRKMALYRNVQPLPLAISLDRDEALRQAEELLVARGVVQRGDFIVLTVGEPMGQAGGTNTLKIVRVGMH

SEQ ID NO: 13661 - protein, 368 aa, Ralstonia solanacearum
MKTKAAIAWKSGAPLTIEDVDLQGPRAGEVLVEIKATGICHTDYYTLSGADPEGIFPAILGHEGAGVVLDVGAGVTSLKAGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFVNPKEVGNVVDHIIQLTDGGADYSFECIGNTQVMRQALECCHKGWGKSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 13662 - protein, 352 aa, Ralstonia solanacearum
MQALGYAAASSTDALVPLRFERREPRPDDVVLDVLYCGVCHTDLHIAKNHGGYTNYPVVPGHEIIGRVTRVGSEVTRFKVGDTVGVGCMVDSCQHCNPCLAGYEQHCQAGPVFTYNGTDRHDHTRTFGGYSNTLVVSDKFVLSIPNGLDPAGAAPLLCAGITTWEPLHQWKVGPGSQVAVVGLGGLGHMALKLAKALGAEVTLLTRSPNKELDARRLGANHVVLSTDASQMASVAGRFDLIVDTVPYEHDVNPYLPTLALNGTLVLVGYMGPLNEPVSARALVFGRKAIAGSFIGGIAATQAMLDFCGAHNVVSDVEIIPIQQINAAYERLLKSDVKYRFVIDMSSLAADKP

SEQ ID NO: 13663 - protein, 433 aa, Ralstonia solanacearum
MSSPSRSVSLFERAQKTIPGGVNSPVRAFRSVGGTPRFIAKAAGPYLWDADGTRLIDYVGSWGPMIVGHAHPEVVRAVQQVAADSFSFGAPTEAEVVMAETLCELVPSIEQVRLVSSGTEATMSALRLARGFTGRDLIVKFEGCYHGHADSLLVKAGSGLLTFADTTQNAPSSAGVPEDVVKHTMVLPYNDADALREAFARHGKEIAAVIVEPVAGNMNLVRATAAFLQAMRALCTEHGAVLIFDEVMTGFRVALGCAQALYGITPDLTCLGKVIGGGMPAAAFGGRRDIMGFLAPLGSVYQAGTLSGNPLAVAAGVTTLRLIAADGFHDRLAAQTRKLVDGLAGIARDAGVPFAADSVGGMFGLYFREGVPTSFAEVTQSDVGRFNAFFHAMLAEGVYLAPSAFEAGFVSSMHDDAVLEATFEAARRAFKAV

SEQ ID NO: 13664 - protein, 370 aa, Ralstonia solanacearum
MSALFQPFSLRGLRLDNRIVISPMCQYSADQGQATAWHQTHLGALSLSGAALLMIEATAVSPEGRITPGCLGLWDDATEAALAGALAAIRPHAQTPIGIQIAHAGRKASSARPWEGGALLPPESGGWETIGPSALPQRPEERPPRTMTEADLARVREAFAATARRAVGLGLAAIELHAAHGYLLHEFLSPLANQRTDAYGGSRENRMRYPLEVFEAVRAAVPDDIPVGVRVSCTDWVEGGWTLADSVAFAQALRARGCDWVDASSGGVSPLQQIPLSSGYQVPFADTIRHQAGIPTIAVGLINEPHEAEAILAEGRADLVAMGRAFLYNPHWAWTAAADLGATIKAPPQYWRAFPRHAKNLFGETHFGAR

SEQ ID NO: 13665 - protein, 500 aa, Escherichia coli
MKRASLLTLTLIGAFSAIQAAWAVDYPLPPTGSRLVGQNQTYTVQEGDKNLQAIARRFDTAAMLILEANNTIAPVPKPGTTITIPSQLLLPDAPRQGIIVNLAELRLYYYPPGENIVQVYPIGIGLQGLETPVMETRVGQKIPNPTWTPTAGIRQRSLERGIKLPPVVPAGPNNPLGRYALRLAHGNGEYLIHGTSAPDSVGLRVSSGCIRMNAPDIKALFSSVRTGTPVKVIDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 13666 - protein, 460 aa, Ralstonia solanacearum
MAEQSIASATARDAAGFADARAVDRYFQITARGSTHRREVVAGITTFMAMVYAVFVVPGMLGKAGFDTSAVFVAVCLTTAFGSLLMGLWARLPIAIGCAISLTAFMGFGLVLGQHLTPGVALGAVFLMGMVFTAISITGVRSWILRNLPAGVAHGAGIGIGLFLLLIASNDVGLVVKNPGPGLPVSLGHITAFPAVMSVLGLAAIFGLERRRVPGGILIVIVAVSALGLLLDPAVKFTGVFALPSLSAPGHAPLIGAMDLRGALSAAVLPSVLALVMTAVFDATGTIRAVAGQAGLLDGKGHIRNGGRALTADSISSMVSAFFGSAPAAAYIESTVGVAAGGRTGLTAVVVGALFLAVMFVSPLAGLVPSYATAPALMYVGLLMLSSVSRLHMDDMVDALAGLVCAVFIVLTCNIVTGIMLGFCTLVVGRIVAGEWRKLNVGTVAIAVVLATFYAGGWAI

SEQ ID NO: 13667 - protein, 435 aa, Ralstonia solanacearum
MQGKSRNCRRLRYDKPKFRNTVPYYGTTVQRSDPETTAMTARNAFHWADPLLLDAQLTDDERMVRDAAAAYAQDKLMPRVLESFRHEKTDTAIFREMGALGMLGPTIPEQYGGPGLNYVSYGLIAREVERVDSGYRSMMSVQSSLVMVPIHAFGSEAQKQKYLPRLATGEWIGCFGLTEPNHGSDPASMVTRAKKVDGGYSLSGAKMWITNSPIADVFVVWAKLPDDNGEDQIRGFILEKGWKGLSAPAIHGKVGLRTSITGEIVLDEVFVPEENLMPGVHGLKGPFTCLNSARYGIAWGALGAAESCWHTARQYVLDRTQFGRPLAANQLIQKKLADMQTEITLGLQGCLRLGRMKDEGTAAVEITSIMKRNSCGKALDIARMARDMLGGNGISDEFGVIRHVVNLEVVNTYEGTHDIHALILGRAQTGIQAFF

SEQ ID NO: 13668 - protein, 473 aa, Escherichia coli
DRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERSCAYVVLKAPHHSLSLEEVVAFFSRKRVAKYKYPEHIVVIEKLPRTTSGKIQKFLLRKDIMRRLTQDVCEEIE

SEQ ID NO: 13669 - protein, 371 aa, Ralstonia solanacearum
MTSQSDETSQNKDAALAAELAPLRAQIDAIDSQLLTLLSDRAKVAQAVGEVKKHYASPAFRPDRELQVIRKMQSGNPGPLHGESIAAIWREVMSACRGLEQALRIGYLGPVGTFTEQAVFAHFGHEIQPMPCPSIDEVFRAAEAGTVDCGVVPVENSTEGVVSRTLDLFLQTSLKISGEIALRVHHNLLHKTGDMSQVKVVRAHAQALAQCQRWLNTNYPNLAREAVSSNAEAARMAGEDETVAALASVQAANRYGLHVVRANVEDDPHNRTRFVVIGNYETEPSGRDQTSLILSVPNEAGAVYRLLAPLAENGVSMCRFESRPARSGAWEYYFYVDVEGHQRDPQVARALEKLRHDAAYFKVLGSYPSAH

SEQ ID NO: 13670 - protein, 300 aa, Ralstonia solanacearum
MAYPTIEDTIGNTPLVRLQRIPGEDNARRGNVILGKLEGNNPAGSVKDRPALSMIKHAETRGRIKPGDTLIEATSGNTGIALAMAAAIRGYKMVLIMPEDLSVERRQSMAAYGAEIVLTPVKGGMEYARDLADAMERDGKGVILDQFANPDNPLAHYEGTGPEIWRDTEGRITHFVSAMGTTGTITGVSRFLKEKNPAIQIVGAQPAEGSRIPGIRKWPEAYMPKIYDPKHIDRTESVSQSDAEHMARRMAREEGIFCGISAAGALCVALRVAEAVENATIVFVVCDRGDRYLSTGVFPA

SEQ ID NO: 13671 - protein, 307 aa, Ralstonia solanacearum
MATGLYTHPEFLKHEMGHHHPECPDRLRAIEDQLIASRIEQFLVPCEAPPATEAQLCRVHRPEYVRELVASVPIAGYAPIDPDTAMNPHTYMAAVLAAGAAVQATDKVIAGALENAFCCVRPPGHHAEPGRAMGFCFFNNVAVAARHALDHHGLARVAIVDFDVHHGNGTEAAFRDEPRVLMCSFFQHPFYPYSGTEGVAANMVNIPLPAYTNGLTVREVVETIWLPRLDAFRPEMLFISAGFDAHREDDLGQMGLVEADYAWITRQLMQVARAHAKGRIVSCLEGGYNLSALGRSVVAHVKALAEL

SEQ ID NO: 13672 - protein, 176 aa, Ralstonia solanacearum
MNSASDTHFSLFGLPEHFEVDDGALNAAYRTVQSRAHPDRHAHASDAERRVAMQWATRANEAYQTLRDPLKRATYLLHLRGVDVQAENNTAMPPAFLMQQLEWRESLADAKAAGDLDALDDLLAMLRGEKRARYQTLAGLLNGGGHDAAAADAVRQLMFIEKIERDTAEAIDRLDD

SEQ ID NO: 13673 - protein, 334 aa, Ralstonia solanacearum
MKPGILVTRAIFPEVLARLRETFDVADNQADAVHPPEALAERLQGRVGLLANAADAINADLIARVPTLRAVANMAVGYNNLDLPAMTRAGILATNTPDILTETTADFGWALLMAAARRVPESERWLRAGHWKRWTYDMFLGAEVHGSTLGILGMGRIGQALARRASGFSMRVIYHNRSRLSPEIERDTRATYVGKDELLAQADHLVLVLPYSSESHHAIGAAELARMKPTATLVNLARGGIVDDAALARALAEKRLFAAGLDVYEGEPAVHPALLEAEPVSLTPHIASATHGTRLGMANLAADNLIAALGFGPRAGQPPNLLNPEALSVRRASA

SEQ ID NO: 13674 - protein, 454 aa, Ralstonia solanacearum
MLPPSPVIDVRAWLDRQRFSAFQWSVVLLCFFVVAIDGFDTACVGFIAPALAQDWHIGPAVLGTVFSAGLAGLMVGALIFGPLADRIGRKQTLLFTVGAFGLASVLSAFAPSVGALVALRFLTGLGLGGAMPNAIALTSEYCPERRRAFLTTVMFCGFTLGSGFGGIVAAQLVPEFGWRSVLLFGGVIPLLLLPVMVFALPESVRYLVAKGGQSAAVGRLLNRIAPVQVTPDTRFVLHETAAKGAPGSPVRQLFLPAFRTGTLLLWSVFFMSLLIVYLMTNWLPTLIHSGGVALALASRIAVMYQLGGTVGALVIGRMMDRYPATVVLCCTYGLGAGFLVLTGVSQGTMLAIAVTGVGFCISGSQIGANAFAAQFYPTASRVTGISWALGIGRLGSVCGALIGGVLLAANIGFQLLFLLVAVPAAIASLAIFLCGAQARHVETQGALPAVTEGA

SEQ ID NO: 13675 - protein, 427 aa, Ralstonia solanacearum [sequence omitted]

SEQ ID NO: 13676 - protein, 179 aa, Ralstonia solanacearum
MLLRFSAKELTMTQVKLHTNHGDITLALDAEKAPKSVANFVHYVKKGHYNGTVFHRVIKGFMIQGGGFEPGADMKQKPTDAPIDNEANNGLKNERGSIAMARTNDPHSATAQFFINVVDNDFLNHTSPTPQGWGYAVFGKVTEGLDVVDKIRAVRTGNRGYHQDVPMEDVVIESAEVIE

SEQ ID NO: 13677 - protein, 190 aa, Ralstonia solanacearum
MLRIRSLFAGLVCALAVSVSAAAAPAPRVQFKTSMGDFTVEVYPDKAPKTVANFLQYVKDGFYKGTIFHRVMDGFMIQGGGFTPDMKQKDTRAPVEIESKNGLKNDKYTIAMARTMDPNSATAQFYVNVVNNDMLNYPGQDGYGYTVFGKVVEGTATIDKIKGVETTSKLPHQNVPVTPIVIESVTLVTK

SEQ ID NO: 13678 - protein, 448 aa, Ralstonia solanacearum
MFLADIRSIAALAWPVLVGQLAVIAFGVLDTAMAGRASAADLAAIGLGGSIYVTVYISLMGVLQALSPIAGQLYGAGRHGEIGEEVRQAAWLGLALSAIGMLLLWFPAPLLRLADASPELTSKATAYLRYEALALPAALGFRIYSALNNALSRPVMVTVLQLGGLALKFPLNALFLYGGLGLPAMGGPGCALASMIIGWLWCIAGALILMRNPVYRPFRIFTQFSPPHLGRLWGLVRLGVPMGLTYLIEITSFTLMAIFIARMGTVVLAGHQIAANVGAVAYMVPLSLSIATSTLVAQMIGARDRDAARRIAWNGLKLAAACAIAVGGCVLLLRRDLVGLYTRDATVMAIAVPLLPFIAFYQLFDALQVTAAFILRAYKIALIPTVIYALSLWGVGLGGGYLLGFGLLGESAAALRGAAGFWAANALSLAVAGTLLVGYFNRISRAAD

SEQ ID NO: 13679 - protein, 378 aa, Ralstonia solanacearum
MFQSLFPGAEMTQQLLSPIQVGQTALANRVVMAPLTRSRAAQPGDVPTELNGTYYAQRATAGLIVTEATQVSRQGQGYAWTPGMYTDAQEAGWKAVVDAVHAKGGRISQQLWHVGRISHTLLQEGGQAPVAPSAIVAQGAQSFVVQPDGTPANVPTSEPRALATEEIPGIIAQYRQAVQRARRAGFDFVEIHAANGYLLHQFLSTNSNQRADQYGGSLENRARLILEVVDAAIAEIGAERVGIRLSPHFVAHDIADAEAETSALYLARELTRRGVAYLHIAEPDWAGGPELSDAFRRQLRDAFKGALIVCGQYTAEEGEQMIASGLADAVAFGRPFIANPDLVARFRAGAGLNTPDRSTFYGGQEKGYTDYPTLEEAA

SEQ ID NO: 13680 - protein, 471 aa, Ralstonia solanacearum
MSQSIADVMKLVKENDVKFVDFRFTDTKGKEQHVSVPVSHFGEDKFESGHAFDGSSIAGWKGIEASDMLLMPDANTAHIDPFYEEPTLVMTCDVIEPSDGKGYDRDPRSIAKRAEAYLKSTGLGDTAYFGPEPEFFIFDGVTWNVDMQGSFVKIHSEEAPWSSGKEFEHGNSGHRPGKKGGYFPVAPIDTFQDIRSEMCLILESLGIPVEVHHHEVAGQGQNEIGTKFSTLVQRADWTQLQKYVIQNVAHTYGKTATFMPKPVVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLCNPYLGFAALLMAGLDGVQNKIHPGEAADKNLYDLPPEEDAKIPTVCSSLDQALEYLDKDREFLTRGGVFTNSMIDAYIELKMEEVTRFRMTTHPVEFEMYYSL

SEQ ID NO: 13681 - protein, 478 aa, Ralstonia solanacearum
MSKQFDVLVIGAGPGGYIAAIRAGQLGLNVACCEDNAYDDPKGEPRLGGTCLNVGCIPSKALLASSEEFENVNHHLADHGITVDGARVDVAKMLKRKDDIVGKMTKGIEFLFRKNKVTLLKGHGKFVGKTDAGYQVEIAGKAGTEVVTAKHVIIATGSKARHLPGVPVDNVTIADNEGALKFGEVPKKLGVIGAGVIGLELGSVWRRLGSDVTILEALPSFLGAADESVAKEANKLLNKQGLKINVGVKVGEIESSAKGVKVNYTDATGAAQVLECDKLIVSIGRVPNTDNLGLDAIGLATDQRGFIEVDDHCATKLPNLWAIGDVVRGPMLAHKAEDEGVAVAERIVGQKPHIDYNCIPWVIYTFPEIAWVGKTEQQLKAEGREIKAGQFPFMANGRALGMGASDGFVKVIADAKTDEILGVHVVAANASDLIAEAVVAMEFKAAAEDIGRICHPHPSMSEVMREAALAVDKRQLNM

SEQ ID NO: 13682 - protein, 372 aa, Ralstonia solanacearum
MSIQVQHVTKRFGNFVALDDVSLAFRQGELTALLGPSGCGKTTLLRIIAGLEHADAGTILLNGEDASDRHVRERQVGFVFQHYALFKHMTVFENVAFGLRVKPRAQRPSEAQIRAKVKALLELVQLDWLAERYPPQLSGGQRQRIALARALAVEPRVLLLDEPFGALDAKVRKELRRWLRRLHDDLHVTSLFVTHDQEEALEVADSVVLMNRGQVEQVGSPDAVYNTPATPFVYGFLGNVNLFHGRLEAGEGGSVLHVGETALSVPPGGVDASRADQAVAFVRPHEIDLERYAPGAEGIPVTLRRALTLGAVAQLELERTDSDDIIEVSLPIERFRAQGLREGETLVVRPRAIRVFAQGQGSEHAAAAQAAA

SEQ ID NO: 13683 - protein, 168 aa, Ralstonia solanacearum
MTTMMIPVTDLCDAHEDQLASGAVRVLAPVFRSFGARAAFAGPAATLKVFEDNGLVRAMLEQPGEGRVLVVDGGGSLRCALVGGNLAKLAEDNGWEGVLVNGCVRDTRELAACNVGVHALAAHPRKSFKKNQGERDIGVQMPGAYIHPGEWIYGDEDGVLVSRERLHD

SEQ ID NO: 13684 - protein, 456 aa, Ralstonia solanacearum
MAKSKTVYTCTECGGTSPKWAGQCPHCQQWNTLVETVAQPASGAGARFQSLAASAVVRKLADIDAVDVPRFSSGIDEFDRVLGGGLVGGGVVLIGGDPGIGKSTLLLQALSNLAASRRVLYVSGEESGAQIALRARRLGVESPNLALLAEIQLERIQATIEAEKPEVVVIDSIQTLYSEALTSAPGSVAQVRECAAQLTRIAKRLDVTTILVGHVTKEGALAGPRVLEHIVDTVLYFEGDTHSAYRLVRAFKNRFGAVNELGVFAMTERGLRGVANPSALFLSQHEQTVPGSCVLVTQEGTRPLLVEIQALVDAAGVPNPRRLAVGLEQNRLAMLLAVLHRHAGIACFDQDVFLNAVGGVKITEPAADLAVLLAIHSSMRNKPLPRGLVVFGEIGLAGEIRPTPRGQERLKEAAKLGFSIAVIPKSNAPKQPIDGLQVIAVERIEQAIDRVRGLEA

SEQ ID NO: 13685 - protein, 417 aa, Ralstonia solanacearum
MLAQPPGPLRPIRSMPNTVNPRLSSLQPYPFEKLKALVKDVTPSPAHAPISFGIGEPKHPTPALVKDALTASLAGLANYPTTAGSDALRQCIAAWLERRYGLPKVDAATEVLPVNGSREALFAFAQTVIDGSKPGARVLCPNPFYQIYEGSALLAGAQPLFANSNPARNYAPDFDAITPEEWRNVQLVFVCSPGNPTGAVLTLEDWKQLFALSDRYGFVIASDECYSEIYFDEANPPLGALQAAHQLGRGFERLVMFSSLSKRSNVPGMRSGFVAGDAKLIKAYLLYRTYHGSAMNPAVQSASIAAWNDETHVRENRAQYVRKFQSVTPMLAEVLDVALPDAAFYLWANVKRTGLSDTAFARELLAAKNVAVLPGSYLAREAHGVNPGQDYVRIALVAGVDECLDGARRIVEFCQQR

SEQ ID NO: 13686 - protein, 487 aa, Ralstonia solanacearum
MRLVQKALTFDDVLLVPAYSAVLPRDTSLRTKLTRTIELAIPLVSAAMDTVTEARLAIAMAQQGGIGIVHKNLKPEEQAREVAKVKRFESGVLRDPITIGPDMKVRDVMALSAQHGISGFPVLEGNKVVGIITNRDLRFEEELDAPVRAKMTPGEKLVTVREGASLEEAKRLMNKHRLERVLVVDGNFELRGLITVKDIQKATEHPLASKDERGSLRVGAAVGVGPDNDLRVDLLVKAGVDVIVVDTAHGHSQGVLSRVRWIKDKYPQVQVIGGNIATAEAAKALVDHGADGVKVGIGPGSICTTRIVAGVGVPQISAVSNVAEALKNTGVPLVADGGVRYSGDIAKALAAGAHTVMMGGMFAGTEEAPGEVFLYQGRSYKSYRGMGSVGAMKDGAADRYFQEDNTANVDKLVPEGIEGRVPYKGSVLPIVHQLTGGIRSSMGYCGCASIAEWHEKSQFVQITAAGMRESHVHDVQITKEAPNYHLD

SEQ ID NO: 13687 - protein, 478 aa, Ralstonia solanacearum
MQQRDTLFINGQWVAPQGKGTIDVIHSTTEAVMGTIPEGSAADAEAAVAAARAAFDGWAATPAPKRAEIIQKIADGLKARSEALAQLIAGEVGMPIKLARAIQVGSPVFNWGHFARLLGAFPFEARVGNSLVVREPVGVVGAITPWNYPLHQITLKVAPALAAGCTVVLKPSEVAPLNAFVLAEVIEAAGLPPGVFNLVTGYGPVVGEVLASHPEVDMVSFTGSTRAGKRVAELASQTVKRVALELGGKSASVVLDDADLAAAVKGTLSACFLNSGQTCSAHTRLLVPRARYEEVKALAKQFAATYVPGDPAQETTRLGPLISAVQRDRVLGYIRKGLEEGAELIAGGPEKPEGVSTGYFVRPTVLGNVKPSDTVAREEIFGPVLTILCYDDEEEAIRIANDSIYGLAGGVWSGDEARAMRVARRIRTGQVDINGGPFNMLAPFGGYKQSGNGREQGQYGLEEFLEYKALQLKPAQAT

SEQ ID NO: 13688 - protein, 468 aa, Ralstonia solanacearum
MAYPPIPVPADAAPSANTAWQARSRAAVWHPCTQNARLDAMPPLPIARGQGPWLIDFDGKRYLDGTSSWWVNLFGHANPHINAALKAQLDMLEHTMLAGATHRPAVELAERLVGLTGGVLGHSFFGSDGASAVEIALKMSFHAHRNAGQGARSRFVCLEHGYHGETLGALGVTDVAIFRDAYDPLILQSHRVASPDARLAGPGETGADVAERALAALRDCLSANAGTIAAVIIEPLVQCAAGMAMHDASYLRGVRALCDQFGVHWIADEIAVGCGRTGTFFACEQAGVWPDLLCLSKGISGGYLPLSIVLSRDAIYDAFNEDAPVRSFLHSHSYTGNPLACRAALATLDLFAEEDVFARNRVTAARIAQGLAPLSHDARFAHLRQAGMITAFDVHPEVAGPRFAERFALTARAHGLLLRPIGHTVYLLPPYVLTDDETDTLVERTLHTLEDTLAQATGAHEGETHAIA

SEQ ID NO: 13689 - protein, 334 aa, Ralstonia solanacearum
MQAMVCSRAGAPLQWQTVPRPEPGPGEVRIAVSVCGVCRTDLHIVDGELPDPKPALIPGHEIVGTVDACGPGVSGLTTGERVGVPWLGWSCGTCPFCRRDQENLCDRPRFTGYTRDGGYAEYTVCDARYCLPIPARYDDAHAAPLLCAGLIGYRTLRMAGDARRLGIYGFGAAAHLVTQIAVAEQREVFAFTRAGDTGAQQLARDTGACWAGASEAPPPAPLDAALIFAPVGALVPLALQAVVKGGTVVCGGIHMSDIPAFPYRLLWEERKLMSVANLTRADGLALMRVAATVPLQSHVTLYPLAEANAALDDLRAGRVTGAAVLQVRSPIDGP

SEQ ID NO: 13690 - protein, 444 aa, Ralstonia solanacearum
MSKARFDTLALHAGAAPDPATGARATPIHLTTSFVFRDSEHAASLFNMERAGHVYSRISNPTVAVFEERMAALENGVGAIATASGQAALHLAIVTLMGAGSHIVASSALYGGSHNLLHYTLRRFGIETTFVKPGDIDGWRAAIRPETRLLFGETLGNPGLDVLDIPTVASIAHDAGVPLLVDSTFTTPWLLQPFAHGADLLYHSATKFLGGHGTTIGGVLVDAGTFDYVAAGRHPELTEPYAGFHDMVFAEESTVAPFLLRARREGLRDFGACMNPMAAWQLLQGVETLPLRMARHVENTRRVVAFLAGHPMVASVAYPELETHPDHALAKRLLPRGCGAVFSFDLRGDRRAGQQFIESLGLFSHLANVGDARSLVIHPASTTHFRMDAAALAAAGIGEGTIRLSIGLEDADDLIDDLKRGLKAAERAMSAASGKTAPAPTGAR

SEQ ID NO: 13691 - protein, 232 aa, Ralstonia solanacearum
MNKIYASAAEALAGIVKDGQTIAVGGFGLCGIPEALIGALRDSGAKGLTCISNNAGVDGFGLGRLLETRQIKKMISSYVGENKEFERQYLSGELELEFTPQGTLAEKLRAGGAGIPAFFTRTGVGTVVADGKEVREFDGEQYVMERSLIADVALVKAWKADKSGNLKYHRTARNFNPMCAMAGRITIVEVEEIVETGTFDPDEVHTPGVFVQRIVLNAHPEKRIEQRTVRAK

SEQ ID NO: 13692 - protein, 404 aa, Ralstonia solanacearum
MTDETKLPPPFPATQAVHPDLHIPPGFAAFSHATHRASTVVFKNLADMRAFGHGSVVHWRYGLHATPTSDTLCQALAQIEGGRHALLLPSGLGAISLVYFALVKSGDDVLIPDNAYGPTRDHGEWMARQFGITVRYYDPMIGAGIAGLIRHNTRLVWLEAPGSVTMEVPDCTAIAEAARAAGAITAIDNTWSGGLYYQPFAHGIDISVQALTKYQSGGSDVLMGATITNDEALYHTLLSTRMRMGWGVSADDCFLVLRGLPSLPARLAAHDAHAREVAEWLAERPEVVRVLHPALPDCPGHAYWKRDFTGASGLFSIVLHTRYAPAQIDAFVEALRYFAIGFSWGGANSLALPYSVPSMRTATVWPPAGWESAGGLVRLYIGLEDPRDLIADLKKAMEAHLRAA

SEQ ID NO: 13693 - protein, 509 aa, Ralstonia solanacearum
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 13694 - protein, 512 aa, Ralstonia solanacearum
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 13695 - protein, 344 aa, Ralstonia solanacearum
MRTWFNGYSDDSQIRTIVQLRPMPSLDPHVAQLLDLVARAKRPPLHHLAPADAKIAYEKSSPIVDIPPIPLDHVHDLTVPARDGYAIPVRTYAAREASWADPLPLLVYFHGGGFTVGSIRTHDALCRSLAAKSGAMVLSVDYRLGPDWKFPTAADDAFDVLQWVFDEAATIGADPARIAFGGDSAGGTLAAITAIEARNRGLAPVLQLLIYPGTTARETTPSHHAFAEGYLLTQAMIAWFFAQYLRSDADRDDWRFAPLDGGGQGADVRGVCPAWISVAGFDPIRDAGIGYADKLRAAGVPVTLKMYEGMIHDFFKLGRFVPAVEDAHYEAADALRRAFGTQAG

SEQ ID NO: 13696 - protein, 435 aa, Escherichia coli
MFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 13697 - protein, 265 aa, Ralstonia solanacearum
MSRIAQTFSQLSAQGRKGLIPFITAGDPYPELTVDLMHALVKGGANVIELGVPFSDPMADGPVIQRASERALAKKIGLRTVLDYVRAFRATDKTTPVVLMGYANPIERMGIDAFAKAASEAGVDGVLVVDYPPEECEAFAKTMRAAGIDPIFLLAPTSTEARMAQIARVASGYIYYVSLKGVTGAATLDLDSVAARIPQIRQHARLPVGVGFGIRDAATARAIGGVADAVVIGSRIVQLLEEASREQAVQCLTDFIADIRQALDA

SEQ ID NO: 13698 - protein, 248 aa, Ralstonia solanacearum
MSARPKLVVGNWKLHGSLNGNAELLEKIKAAGQTRAALAVCAPFPYLAQCQSVLAGSSVAWGAQDVSAETRGAFTGEVAASMLSEFGCGYAIVGHSERRTYHGETDAQVAIKALRALEHGITPIVCVGETLAQREAGETELVVARQLEAVLESLSVEQLGHIVVAYEPVWAIGTGKTATSEQAQAVHAFLRGRVAACDAGVAQRMPILYGGSVKPDNAAELFTMADIDGGLIGGASLKAEDFLAIGRA

SEQ ID NO: 13699 - protein, 334 aa, Ralstonia solanacearum
MRAIEITQYGGPDVLKPAERPMPEPKAGEVLIRVRAAGVNRPDVFQRTGNYPVPPGASDIPGLEVAGEIVGGDLAHADNRYGLRAGDRVCALVQGGGYAEFCTAPLGQVLPVPAGLSDIEAAALPENYFTVWSNVFDRGQLGQGAHGKGETLLVQGGSSGIGTTAIQMASALGYRVFATAGSDEKCAACVALGAARAIRYRTEDFAEVVKAETGRGVDVVLDMVGGSYVAREIACTADDGRIVLIALLGGAKAEVPLGEILRRRITLTGSTLRPRPVAFKAAIAAHLHDTVWPLLASGRIRPVIHEVMPAEHAAQAHALMESSAHIGKIMLTWG

SEQ ID NO: 13700 - protein, 245 aa, Ralstonia solanacearum
MPLVDLCAVHKHYGNNHVLKGVDLRVESGQVVAIIGRSGSGKSTLLRSINGLEAIDDGQIVVDNAVLKGSQATPAQLRALRLNVGMVFQQFNLFPHLTAGENVALSPVVVKGMKKSEAADLARQMMAKVGLADKYDAYPDQLSGGQQQRVAIARALAMQPKVLLCDEITSALDPELVNEVLAVVKQLAAEGMTLIMVTHEMRFARDVGDQLVFMHQGLIHESGPAKALFANPKTAELAAFIGAVQ

SEQ ID NO: 13701 - protein, 502 aa, Ralstonia solanacearum
MAQLLTVSEYAAMAGKLALPTQAFIDGAFVPAVSGKTFQTTNPATGNVLAEIAACDTRDVDIAVAKAKAAFEDGRWHRRSPAQRKATLLRLADLLEQHAHELAVMESLDSGKPIRECQATDVPETIHTIRWHAELIDKIYDSTAPVGSNALSLVVREPIGVVGLVLPWNFPLLMLAWKIGPSLAAGCSIIVKPAKETSLTALRVAELAHEAGVPAGVFNVLPGGGKEVGEPLGRHMDVSMVSFTGSTDTGRLFLKYAADSNLKRIVLECGGKNPAVVMNDVDDLDAVAQHVVNGAFWNMGENCSASSRLIVHADVKDALLARIGVHMREWKMGNPLDPEHRVGSLVSESHFRKVRSYLEHAGAEQLRVAFGGGTEGGIFVEPTVVDGVGQGSLLFREEIFGPILSVTTFTRMEDAIALANDSVYGLAASVYTDSLNNAIRLSREIRAGVVTVNCFGEGDVTTPFGGYKESGFGGRDKSIWAHDQYTEIKTIWIDVPDCTAAK

SEQ ID NO: 13702 - protein, 442 aa, Ralstonia solanacearum
MANNVSIEDVPLNGFHQLLSIRSGGGWVLDGYVLSIIGVAMVQLSAALHLSGFWQGMVAASALIGIFCGGFLGGLLTGCLGRQKLYFFGPTIFVVCSLAQFWADSGAALFFFRFLIGVGVGFEYPVAGSLLVEFMPRKDRGPRLAMLTILWFAGAALAYMVGNAILDTGRADAWRLVLASPAVIGALLLLVRIGTPESPRWLLSKGRAAEAERVIQQVYGPQFSLENLPEQRPEKKVSLLSLLHSGYGKRMLFVSVFWSCSVIPVFAVYAFAPTVLQALHLKGAWASFGSVAITLLFVVGCFVATRLINTVGRRSMLIHSFLWSGLALLGLGLFCDGSEMLVLVLFGAYAVFIGGAQVLQLVYPNELFPTEIRSAAVGMGASLSRIGAAIGTWAVPVALQGIGVGNTMFAAAGVTLFGLLVSLAIAPETRALSLQEAASLSR

SEQ ID NO: 13703 - protein, 478 aa, Ralstonia solanacearum
MHAQHFIANRLMAADSGLRIKVFDPSDGQPFAEIARGNATDISVAVHAARRAFDGIWGRLAPAERGRLLMRVALRLADHEEELARLEARDTGKPMRQARADARAIARYFEFYAGAADKLHGQTIPYQPDTTVLTVREPHGVTAHIIPWNYPMQIFGRSVGAALAVGNACVVKPAEDACLSILRVAELAAEAGLPDGALNVVTGYGHEAGAALAAHPGINHVSFTGSPETGKLIVRAAAENHVPVTLELGGKSPQILFADADLDAAIPAVVSGIVQNAGQTCSAGSRVLIERGLYETVLDRLASVFEAIKVGPSTLDLDCGPLINPRQQQRVWDFVSDAQHANIPVMAQGLVVPEAPETGYYQAPMLLRDVPPTHRLAQQEVFGPLLAAMPFDGEAEALALANGTPYGLVAAVWTRDGARQLRLARALKAGQVFINNYGAGGGVELPFGGTGQSGHGREKGFEALYGFTTVKTIAIRHG

SEQ ID NO: 13704 - protein, 298 aa, Ralstonia solanacearum
MTRIAFIGLGNMGSPMVQHLIAAGHAVRAYVRRPEAAEHARALGAEPCASPADAARDAEAIFTNVTSTADVEAVLLGPDGVIHGAPRGKPGGAVCIDHSTISAVATRRIAAELEAAGLDFLDAPVSGGTLGAQKATLSIMVGGKAEVLERARPLLQLLGTTITHIGGHGAGQVAKACNQIVQVINIQGIAEAMLFARAQGTDPSRVLAAIGPGFAGSRMLDMMGPKMAERNFAAGIEARLHDKDFGLVRDIARELGLKMPAMELVASQLDALVDSGWGYDDTSSLLRVLEAQNGRAPS

SEQ ID NO: 13705 - protein, 399 aa, Ralstonia solanacearum
MAFADYPVQSLMYITNRPEIVFTEGKGSWLTDHNGKRYLDFVQGWAVNCLGHSNDGMIEALNAQAKKLINPSPAFYNEPMAKLAGLLSAHSCFDKVFFANSGAEANEGAIKLARKWGKKHKSGAGKNRFEIITFDHSFHGRTLATMSASGKAGWDTIFAPQVPGFPKAILNDIASVEALITDETVGVMLEPVQGEGGVLPATQEFMQQLRALTRKHKLLLIVDEVQAGCGRCGTLFAYQLSNIEPDIMTLGKGIGGGVPLSALLCTDEVASFEAGDQGGTYNGNPLMTAVGCSVIEQLLAPGFLAGVQERGAYLRAQLLELSEAFGLAGERGEGLLRALLLGKDIGGQLVEAAREMNPTGLLLNAPRPNILRFMPALNVTTDEIDTMIGMLRTLLKAHG

SEQ ID NO: 13706 - protein, 222 aa, Ralstonia solanacearum
MRLILLGAPGAGKGTQAKFICERFGIPQISTGDMLRAAVKAGTPLGIEAKKVMDAGGLVSDDIIIGLVKDRLQQSDCKNGYLFDGFPRTIPQAEAMKDAGVPIDYVLEIDVPFDAIIERMSGRRVHVASGRTYHVKYNPPKNEGQDDETGDPLIQRDDDKEETVRKRLSVYENQTRPLVDYYSGWAENGNGAAKVAPPKYRKISGIGNVEDITGRVFGALEA

SEQ ID NO: 13707 - protein, 504 aa, Ralstonia solanacearum
MHPAFTSDADVGHYINGARLPGRSGRFQDVFNPAAGKAARRVALAEADEVNQAVAAAKAAFPAWADTPPIRRARVLHRFLQLMNEHRDALAAIITAEHGKVFSDAQGEVARGIDIIEFACGIPQLLKGDYTDQVSTGIDNWTMRQPLGVVAGITPFNFPCMVPCWMFPVAIAAGNTFVLKPSERDPSASLLIADLLMRAGLPAGVFNVVQGGKPVVDTLLDHPDVQAVSFVGSTPIAAYVQQRGVQAGKRVQALGGAKNHLVVMPDANLDQAVDALIGAAYGSAGERCMATSIAVLVGDVADRIVPALAERARTLVVGDGMMPDVEMGPIVTREALQRIEGYVEQGVAEGAKLVVDGRGLRVPGREQGFFTGGTLFDHVTPSMRIYQEEIFGPVLGCVRVKDFAEAVSLINAHEYGNGVACYTSDGGIAREFARRIQVGMVGINVPIPVPMAWHGFGGWKKSLFGDMHAYGEEGVRFYTRQKSVMQRWSSSIGKGAEFAMPTAK

SEQ ID NO: 13708 - protein, 165 aa, Ralstonia solanacearum
MSDIYAFEADSLAGQRVPLSQYRGKVLLIVNTASQCGFTPQYAGLEAVYKRLNEKGLEVLGFPCNQFGKQEPGGAEEIGAFCEKNYGVSFPMFGKIEVNGSNAHPLYKWLTSEKPGVLGTEAIKWNFTKFLLRRDGTVYKRYAPLTKPEEMLGDIETLLAEPDPL

SEQ ID NO: 13709 - protein, 182 aa, Ralstonia solanacearum
MLSAEQARELWANSEEIVSEAAVHASLDRMAAEITEKIGDTFPMVLSVMGGACVFTGMLLPKLAFPLEFDYIHLSRYNNKTVGGEMQWRVAPRESVKDRTVLVLDDILDEGETMAAIRSRIIDMGAAEFYSAVLCEKTLAKDKPLHPDFCGFPVPDRYVFGCGMDAKGYWRNLPAIRALRNS

SEQ ID NO: 13710 - protein, 238 aa, Ralstonia solanacearum
MLDREGFRPNVGIILINARNEVFWGKRIGEHSWQFPQGGIKYGETPEQAMYRELHEEVGLLPEHVRIVGRTRDWLRYEVPDKFIRREIRGHYRGQKQIWFLLRMVGRDCDIQLRATEHPEFDAWRWSQYWVPLDAVIEFKREVYQMALSELSRFVQRSHRAPLSPYGRGGPHRERDGRDNRAGGQAGRNDQNTRGQRQPPTLMVTTSTVIVETVITSRPAAQPIDSSNPDDTPSKDSL

SEQ ID NO: 13711 - protein, 439 aa, Ralstonia solanacearum
MSASPSSSAMAAPAADAANGTSRTRIVFASFIGTAIEFYDFYVYATAAALVIGPVFFPRGSATAQALSAFITFGIAFIARPIGSFLFGHFGDRIGRKSTLVASLLVMGISTTLIGLVPGYDAIGGLAPVLLCILRFGQGIGLGGEWGGAALLATENAPEGKRAWFGMFPQLGPSVGFLASNGLFFGLALSLSDEQFRSWGWRVPFLVSAVLVALGLYVRLKIAETPAFQAAIERRERARVPIAALLAHHWWPTLLGALAMVVCYTLFYISTVFSLSYGVSTLHFTRPGFLGLLCLAVVFMALATPLSAWASDRWGRKPVLLTGILAAILSGFTMAPLLGSGSTPLVALFLILELFLMGVTFAPMGALLPELFPTHVRYTGAGVSYNLGGILGASIAPYIAQVLAAQGGLAWVGAYVSAAAAVSLAGVLCMRETRDARLM

SEQ ID NO: 13712 - protein, 242 aa, Ralstonia solanacearum
MPAAIDPSGFRIAPSILSADFARLGEEVRRVIEGGADWIHFDVMDNHYVPNLTVGPLVCEAIRPHAQRDGKPVPIDVHLMVRPVDRIIPDFAKAGADLITFHPEASEHIDRSLALIRDQGCKAGLVFNPATPLHYLDHVMDRLDMVLIMSVNPGFGGQSFIPEALTKLRAVRQKLDAYADRTGRRILLEIDGGVKADNIAEIARAGADTFVAGSAVFGKPDADGGYRGTVGALRSALEGITA

SEQ ID NO: 13713 - protein, 358 aa, Ralstonia solanacearum
MIELTVNDLHLEYGNNPVLKGVSMQLQKGEVVSLLGPSGSGKTTLLRAVAGLEQASSGTVKIGERVMFDDAAGLDVPAEARNLGLVFQSYALWPHKTVAENVAYPLKLRKTPPAQIKERVQAVLQQLGLGHLGERFPSQLSGGQQQRVAIARALVYNPPVILLDEPLSNLDAKLREEARAFLRELIVRLGLSALMVTHDQGEAMAMSDRILLLNNGVIEQQGTPEQMYGAPETLFTAEFMGSNNRINGKIAEVRDGMARLVDEAGGWSLWGVARGDLKPGATAHGVIRLEQVRVGLDNADNTIRLPLATRMYLGDRWECLFRGTGAAGTGLRAYASNAPGDGEYALTFPREQFWLFAA

SEQ ID NO: 13714 - protein, 140 aa, Ralstonia solanacearum
MSRKWLNKVKWDDHGLVPVIVQEQGSNDVLMFAFMNREALQKTVETGEAVFWSRSRKRLWHKGEESGHIQQVHEIRLDCDEDVVLLRVTQVGGIACHTGRHACFFQKFEGTAEDGDWHTVEPVLKNPDDIYAGKPGHNHE

SEQ ID NO: 13715 - protein, 279 aa, Ralstonia solanacearum
MSSQSSTAVVELDQVDFAYQPGARRILSGLCMRVPKGSVVAVMGGSGCGKTTVLRLIGGQVAAASGAVRVHGADIGAMDKPALYAARRQMGMLFQFGALFSDMSVFDNVAFPLREHTELPDLLIRDLVLMKLNAVGLRGARDLMPSQISGGMARRVALARAIALDPSLILYDEPFAGLDPISLGLTASLIRSLNDALGATSIIVSHDVQETFQIADYVYFVANGGIAAEGTPAELSASTDPFVRQFVHGEPDGPVPFHYPGVPLAEDFGVGGRRDGEAQ

SEQ ID NO: 13716 - protein, 487 aa, Ralstonia solanacearum
MGKATGFLEFPRQNEAYEAPAARVKHYKEFVFALADSEAKIQGARCMDCGIPFCNNGCPVNNIIPDFNDLVYRQDWKTAIEVLHSTNNFPEFTGRICPAPCEAACTLGINEAPVGIKSIEHAIIDKAWAEGWVQPQVPRHKTGKTVAVVGSGPAGLAAAQQLARAGHDVTVFEKNDRIGGLLRYGIPDFKLEKTQIDRRMQQMEAEGVTFRTGVMVGDKTVPAGICNDARETLAAQDILKTFDAVVLTGGSEVPRDLPVPGRDLDGVHYALEFLIPQNKEVAGDAPNPIRADGKHVIVIGGGDTGSDCVGTSNRHGAASVTQFELLPRPPEEENKPLVWPYWPIKLRTSSSHDEGCERDWSVATKALIGENGRVTGLKAVRLEWKDGKMAEVEGSEFLLKADLVLLAMGFTHPVGGVLEAFGVAKDARSNARAATEGDNAYATNVPKVFAAGDVRRGQSLVVWAIREGRQAARAVDAFLMGHSVLPR

SEQ ID NO: 13717 - protein, 504 aa, Cucumis sativus
MDMNVPNYKLGKTLGIGSFGKVKIAEHALTGHKVAIKILNRRKIKNLDMEEKVRREIKILRLFMHPHIIRLYEVIETPSDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSSGARELIPSMLVVDPMKRITIPEIRQHPWFQAHLPRYLAVPPPDTMQQAKKIDEDILQEVVKMGFDRNQLVESLRNRIQNEATVAYYLLLDNRFRVSSGYLGAEFQETMETGFNRMHPSDPTNPAVGHRLPGYMDYQGMGLRAQFPVERKWALGLQSRAHPREIMTEVLKALRELNVAWKKIGHYNMKCRWLPGIPGHHEGMINNPVHSNHYFGDKSTIIENDGVVKSPNVIKFEVQLYKTREEKYLLDLQRVQGPQFLFLDLCAAFLAQLRVL

SEQ ID NO: 13718 - protein, 506 aa, Ralstonia solanacearum
MRYAHPGTPGAVVSFQSRYGNYIGGRFVPPVKGQYFTNTTPVTGEAIAEFPRSTAEDIDRALDAAHAAADAWGRTSAQDRSLILLKIADRIEQNLERLAVTETWDNGKPIRETLNADIPLAADHFRYFAGCIRAQEGAAAEINEHTVAYHIHEPLGVVGQIIPWNFPLLMAAWKLAPALAAGNCIVLKPAEQTPLGICVLLELIGDLLPPGVLNVVHGFGKEAGEALATSKRIAKIAFTGSTPVGSHILKCAAENIIPSTVELGGKSPNIYFEDIMQAESSFIEKAAEGLVLGFFNQGEVCTCPSRALVQESIYGSFMDAVMAKVAAIKRGDPLDTETMVGAQASEQQFNKIRTYLEIAREEGAECLAGGEAEAMSGKLANGYYIKPTLLKGHNNMRVFQEEIFGPVIAVTTFQDEAQAIQIANDTEYGLGAGVWTRDINRAYRVGRAIKAGRVWTNCYHLYPAHAAFGGYKKSGVGRETHKMMLDHYQQTKNLLVSYDTRPLGFF

SEQ ID NO: 13719 - protein, 341 aa, Ralstonia solanacearum
MARSMKAAVVHAFGEPLRIEDVPIPTPGRGQILVNIRASGVCHTDLHAADGDWPVKPRLPFIPGHEGVGFVAAVGEGVTAVKEGDRVGVPWLYTACGHCEHCLGGWETLCHDQQNTGYSVNGGYAEYVLADPNYVGHLPAQVGFEEIAPILCAGVTVYKGIRMTDTRPGQWIAISGIGGLGHVAVQYAVAMGLHVVAVDVAPEKLALARELGARLSVDASQQDPAAVIQKEVGGVHGVLVTAVSRSAFAQALGMVRRGGTVSLNGLPPGDFPLPIFSTVLNGITVRGSIVGTRRDLQESLQFAAEGQVRAHIHRDRLDNINQVLADLKAGKVDGRIVLSLD

SEQ ID NO: 13720 - protein, 303 aa, Ralstonia solanacearum
MATSLNLGFIGLGIMGAPMAGHLRAAGHTLFVHDVNPAPAALVEAGVTVCTSAEEVAKRADIVFIMVPDTPHVEAVLFGEKGVAKALKDAGKAAAAGRIVVDMSSISPIATKDFAARVNKLGAQYLDAPVSGGEVGARAASLTIMVGGAQAAFERVLPLFQRMGKHITLVGGNGDGQTTKVANQIIVALNIQAVSEALLFASKAGADPARVREALMGGFAASRILEVHGDRMVKRTFDPGFRIELHQKDLNLALQGAKALGVALPNTATAQELFNTCAANGLGKQDHSALCRAIEIMSNHAIA

SEQ ID NO: 13721 - protein, 1325 aa, Ralstonia solanacearum
MATTTLGVKLDDASRERLKRAAQSIDRTPHWLIKQAIFTYLDQVERGQLPNDAGGPAADGLPSAAAAVADMADADGTEAVVQPFLEFAQSVQPQSVLRAAITAAYRRPETEAIPMLLEQARLPGALASEAKQLARDLAGKLRTQKVGTGREGLVQGLIQEFSLSSQEGVALMCLAEALLRIPDKATRDALIRDKISSGNWQSHLGQSPSLFVNAATWGLLLTGKLVATHNEAGLSKALTRIIGKRGEPLIRKGVDMAMRLMGEQFVTGETISEALANARKYEAEGFRYSYDMLGEAAMTEEDAQRYLASYEQAIRAIGQASGGRGIYEGPGISIKLSALHPRYSRAQYDRAINELYPRVKGLAMLAREYDIGINIDAEEADRLELSLDLLERLCFAPELAGWNGIGFVVQGYQKRCPFVLDYLIDLARRSKHRLMIRLVKGAYWDSEIKRAQVDGLEGYPVYTRKVYTDVSYLACARKLLAAPDVVFPQFATHNAHTLAAIYHMAGQNYYPGQYEFQCLHGMGEPLYEQVVGNKPGKLNRPCRIYAPVGTHETLLAYLVRRLLENGANTSFVNRIADESIPLDELVADPVAVVENMHAEEGALGLPHPKIPLPRHLYGDVRANSAGIDLANEHRLASLSSALLAGTSSVWAAEPTIGDAPYTGGTPQPVRNPSDLRDVVGHVTEATEADVDAALSAAAAAAPIWQATLPEARAALLDRAADLMEGEMQHLMGLIIREAGKTLSNAIAEVREAVDFLRYYAAQVRGGFSNDTHRPLGPVVCISPWNFPLAIFTGQVSAALAAGNPVLAKPAEQTPLIAAQAVRILREAGVPAGAVQLLPGRGETVGAALVKDARTKGVMFTGSTEVARILQRTLAGRLDANGAPIPLIAETGGQNAMIVDSSALAEQVVADVLSSAFDSAGQRCSALRVLCLQDDVADRVLAMLKGGMAELAMGNPDRLSTDVGPVIDAEARDNIVGHIEGMRAKGRRVHQAPAPAACAHGTFVPPTVIELDSLSDLTREIFGPVLHVVRWKRTADNAGLTRLIEQINGTGYGLTLGIHTRIDETIAHIVERARVGNLYVNRNIVGAVVGVQPFGGEGLSGTGPKAGGSLYLLRLLSTCPQDAMRTALELTAGAGTDVETEERRALLAPFDALRDWARRQSPGLAALCDRLAAATATGAVLTLPGPTGERNTYMLLPRDAVLCVAADPADWLRQLAAVLAVGSEAVVQENPAIAEVLRTLPSAVQSRVRTVASLEDAAFDAVLHHGDSDHLRALCEGLARRAGPIVGVQGLPHGGQGLALERLLIERSLSVNTAAAGGNASLMTIG

SEQ ID NO: 13722 - protein, 322 aa, Ralstonia solanacearum
MAVDPQILQFHQRLAERFGALPLPADALARRARFAAVAEVLARPDPEGIEASDLTLPLPGRTLDAVMFRPRSVQRPRLLVWFHGEGWMVGAARTTHRLMCALLAADTGCAVISVDYRLAPEHPFPAPTDDARDALAYLAEQRLHLSLDPDFLAVGGDSAGGHLAAQAAQAVHDRVRQGLVTAQLLVCPATMPAFGSESYSAFAQGPGLTRDEMRWYWAQFIGEAALDRPLAEQDARLFLMADPPAHLPPDTVVIVAAHDVLRDDGLAYADHLVQHGAQVVTIEASGMTHGFARLQPEAERAREWMRRAAHAFVGMIGGDAAG

SEQ ID NO: 13723 - protein, 449 aa, Ralstonia solanacearum
MGTNGEAVIELRGVSKIFRTADRTDRAVLEGVDLTLRQGEIVAMLGKSGSGKSTLLRIMAGLVRADRGKVLFRGREYGGPVQGIAMVFQSFALFPWLTVQQNVELGLEAQGVPKAEREERAEAAIDLIGLSGFNSALPRELSGGMRQRVGIARALVTEPDLLLMDEAFSALDVLTGENLRDEMLDLWEDRRTNIKSILIVSHNIEEAVMMADRIVILSSDPGRIRAEVRVPFARPRNRDSSAVRNLIDEVYGLMTSPEQVGVRVGAPAAEQQLAYRLPDAEIGQMEAILDLLMEAPFNGRADLPHLAEEAGVTDDDLLPACEALSLLQLATLERGDIIVTPFGKTYMETEPPERKVLFGQKLLERVALAAHIRAELDASEDGEVREEQVLRELEAYLKPDEAERVLKIGIEWGRYGEVYEYVYNTGMLTLPREEREEREAEDGGDAASA

SEQ ID NO: 13724 - protein, 253 aa, Ralstonia solanacearum
MIEIRELQKHFGEHHVLRGVSLRVDKGEVVCLIGPSGSGKSTVLRCINGLESYDGGEIRAFGERVDRDGKAIHTLRSRMGMVFQRFNLFPHRSVLENVMEGPVYVKGERPDAARAKAMALLEKVGLAAKAQAYPAQLSGGQQQRVAIARALAMEPEAMLFDEPTSALDPELVGDVLEVMRALAREGMTMIVVTHEMGFAREVADRVCFLHSGTIVEEGPAAQVLGAPRQPRTQDFLRRVLHKPAEPATGDLAL

SEQ ID NO: 13725 - protein, 457 aa, Bacillus halodurans
MAKKKTKFMCQECGYESAKWMGKCPGCQSWNSMVEEFTEVKAKSSRSYVTSGAGIAKPQPITKVEREQEPRIDTSMKELNRVLGGGIVPGSLVLVGGDPGIGKSTLLLQLSARLADLKQRVLYISGEESVKQTKIRSDRLGVLSDHLYVLAETDMEKIEQAIGEVDPTLVIIDSIQTVYQDEITSAPGSVAQVRECTASFMRIAKTTGVAIFIVGHVTKQGAIAGPKLLEHMVDSVLYFEGERHHTYRILRAVKNRFGSTNEMGIFEMKESGLEEVANPSEIFLEDRSSGVAGSTVVASMEGTRPVLVELQALISPTSFGNPRRMATGVDHNRISLLMAVLEKRVGMLLQNQDAYVNVAGGVRLDEPAIDLGIAVSIASSFRNQHTNPHEVVIGEIGLTGEVRRVSRIDQRVNEAAKLGFKRVIIPDKNLGGWTIPSTIEVIGVSTVQDALEVTLGR

SEQ ID NO: 13726 - protein, 372 aa, Oryza sativa
MGEAVKGPVVVTGASGFVGSWLVMKLLQAGYTVRATVRDPSNVGKTKPLLELAGSKERLTLWKADLGEEGSFDAAIRGCTGVFHVATPMDFESEDPENEVIKPTVEGMLSIMRACRDAGTVKRIVFTSSAGTVNIEERQRPSYDHDDWSDIDFCRRVKMTGWMYFVSKSLAEKAAMEYAREHGLDLISVIPTLVVGPFISNGMPPSHVTALALLTGNEAHYSILKQVQFVHLDDLCDAEIFLFESPEARGRYVCSSHDATIHGLATMLADMFPEYDVPRSFPGIDADHLQPVHFSSWKLLAHGFRFRYTLEDMFEAAVRTCREKGLLPPLPPPPTTAVAGGDGSAGVAGEKEPILGRGTGTAVGAETEALVK

SEQ ID NO: 13727 - protein, 226 aa, Petroselinum crispum
MVKIAIGSIGDSFTHGSLKCYLAEFIATLLFVFAGVGSAIAFNNLTADAGLDPAGLVAIAVAHAFALFVGVSIAANISGGHLNPAVTFGLAVGGHITLITGFFYWIAQLLGATVASFLLIFVNGGKAVPIHGVGAGLGAAEGVVFEIIITFALVYTFYATAADPKKGSLGTIAPIAIGFIVGANILAAGPFSGGSMNPARHSGQLLLAETFLDTGSTGLVLSLEEA

SEQ ID NO: 13728 - protein, 376 aa, Solanum tuberosum
HIITAVIGSGVLSLAWATAQLGWVAGPTVLLLFFFVTYYTSALLSDCYRTGDPVTGKRNYTYMDAVRANLGGFQVKICGVIQYANLFGVAIGYTIAASISMVAVNRSNCFHKQGHRAACNVSSTPYMIIFGVMEIIFSQIPDFDQISWLSIVAAVMSFTYSTIGLGLGVAQVAETGKIEGSLTGISIGTEVTEMQKIWRSFQALGAIAFAYSYSLILIEIQDTLKSPPAEAKTMKRATLISVAVTTVFYMLCGCFGYAAFGDQSPGNLLTGFGFYNPYWLLDIANVAIVVHLVGAYQVYCQPLFAFVEKTATEWYPDSKIITKEIDVPIPGFKPFKLNLFRLVWRTIFVIITTVISMLMPFFNDVVGILGAFGFWP

SEQ ID NO: 13729 - protein, 274 aa, Arabidopsis thaliana
MANQSTETNQPSNMQTYGVPIYAADWIPEVDVRSKIIMDPEKSEDDDESSSSSSSSRSCIVLSGGGGEGRSGISNVILICRVDLNTNSLSEQPLGRLVVGSDLPYRMAVHPREGGLICALPNSCKLFHWEDIMSREDNQAGESEEVIKELRDVGQQLALAFNPEGSVLAAGAEDGTLRVFKWPSMNTLLNESQAHSSVKCLTFSESGQFLVSLGGPVCRVWDVNASAAVASLSKEKDEMFASCRFSVDSAGNEVLYIAANTERGGSIITCDTKL

SEQ ID NO: 13730 - protein, 239 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLDRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIGYPSAPEQ

SEQ ID NO: 13731 - protein, 361 aa, Schizosaccharomyces pombe
MTAPKGGARTRRQAAMYSNSSSGIRETMYDLKPHRRKDAAEMKFCQSVLKELLKKQHEAYAYPFYKPVNPTACGCPDYFKVIKHPMDLGTMQNKLNHNEYASMKAFEADMVLMFKNCYKFNSAGTPVHLMGKKLESIFQKLWANKPDFDSETYMGMSSVNTDYYYGDNEVFDSGDEFLEDDGEEFEAVNRQIHKLQSTLQAMKSRARSSSVSRRSRSRSLSVDIYPPITYEMQNELAEQCNYLSADQLSHVAEILRAALPHLRNTDEIEIDVSAMPPDVFYKVYYYVCKGDEIGAEALATASHTHQEKKKGRALSETEQAEKIRQLRAQLDRFSGIAQNKNTVTGNIAAYNTKSLGSDDSS

SEQ ID NO: 13732 - protein, 188 aa, Schizosaccharomyces pombe
SVRNLELLPIPPRERAFDNPWPQYPRVFRVDYGHAEVQAHYGQDFREYSILTKSFEKDEDGNVKGINTVRIEWTKNSKGRWIMKEIRNSEEFFPADLVILALGFLGPEEQATAGMNVDRDARSNISTPTKSYETSVPGIYAAGDSAGQSLVVWGIQEGRQCAREIDLKFQGKTFLPGDGGLVKRTVNC

SEQ ID NO: 13733 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPVGTSRFSCRDKTLLHYMGCSSFSQYTVVADISLVAISHSAPLRSICLLGCGVTTGFGAVTHSAKVESGSTVAVVGCGCVSLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 13734 - protein, 472 aa, Mycobacterium intracellulare
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKKLAEDAAVGDRVLVDDGKVCLVVDGIEGDDVICTVVEGGPVSNNKGISLPGMNVSAPALSEKDIEDLTFALDLGVDLVALSFVRSPADVELVHEVMDRVGRRVPVIAKLEKPEAVDNLETIVLAFDAIMVARGDLGVELPLEEVPLVQKRAIQMARENAKPVIVATQMLDSMIENSRPTRAEASDVANAVLDGADAVMLSGETSVGKYPMAAVRTMSRIICAVEDNSTAAPPLTHVPRTKRGVISYAARDIGERLDAKALVAFTQSGDTVKRLARLHTPLPLLAFTAWPEVRSQLAMTWGTETFIVPMMTSTGGMIRQVDKSLLELGRYKRGDLVVIVAGAPPGTVGSTNLIHVHRIGEDDV

SEQ ID NO: 13735 - protein, 352 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEF

SEQ ID NO: 13736 - protein, 380 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 13737 - protein, 476 aa, Ralstonia solanacearum GMI1000
MPATFPAAAQANAAARLERLPFSGYHKRIFIIIAIAFFFDSVDLATMTFVLGSIKKEFGLSTATAGLVASSSFFGMVIGAAVAGLLADRFGRRPVFQWSMVLWGVASYLCSTAQSVEALIAWRILLGIGMGMEFPVAQTLLSEFVPTANRGRLIALMDGFWPLGFITAGIVSYFVLPQFGWRAVFALLAVPAIFVLIVRRAVPESPRWLEHAGRNAQADTVMRGIEAKVMRSLNTTTLPPIVQHSAPQPVRRHSALREIWSAAYRRRTTMVWLLWFFALLGFYGLTSWLGALLQQAGFAVTQSVYYTVLISLGGVPGFLCAAWLVERWGRKPTCIASLLGGGAMAYLYGQSALYGGSVTLLICTGLAMQFFLFGMWAVLYTYTPEQYGTGARATGSGFASAIGRVGSLIGPYVVGVVLPVFGQGGVFTLGAISFAVAALAVWALGIETRGLALEALASEDAAAETAPYSTTADNIS

SEQ ID NO: 13738 - protein, 368 aa, Ralstonia solanacearum GMI1000
MKTKAAIAWKAGAPLTVEEVDLQGPRAGEVLVEIKATGICHTDYYTLSGADPEGIFPAILGHEGAGVVLEVGAGVTSLKAGDHVIPIYTPECRQCKFCLSRKTNLCQAIRATQGKGLMPDGTSRFSLDGKPLFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFINPKDVGNVVDHIIQLTDGGADYSFECIGNTQVMRQALECTHKGWGQSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 13739 - protein, 411 aa, Ralstonia solanacearum GMI1000
MKLFTPLALPNGAVIPNRLAKAAMEENMADADHAPSEALLRLYGAWAKGMAGLILTGNVMVDHRAMTGPNGVVLEDGTHLDRFRRWARIARAHGAHAWMQINHPGRQMPAALGQTTLAPSAVALELGALSRQFPVPKAMTEADIADVLQRFTRTAQLAEQSGFTGVQIHAAHGYLLSQFLSPITNQRRDPWGGSIENRARLLLEIVRSVRSAVSPGFAVSVKLNSADFQRGGFSPDDAKRVIEMLNPLGVDLVELSGGSYEAPAMQGHARDGRTLAREAYFLEFAQDIAAAARMPLMVTGGIRRRAVAEQVVDSRIAMAGIATALSIDPNLPRDWHAGKDSAPVLRPITWKNKVLGALANMAVVKFQLKRLSEGRVTDPRVSPLRALVLQQLATTCQTRRYRRRMAQRAAR

SEQ ID NO: 13740 - protein, 484 aa, Ralstonia solanacearum GMI1000
MFESQLLIGGKQRAAAGGATCERPNPATGDVASRAAAASLADADAAVQAAHAAFPAWAAMLPGERRRLLLKAADVMERRADDFIARGVAEAGGVPGWYGFNAALAAGMLREAAAMTTQVGGEVIPSDVPGSLAMGLRQPCGVVLGIAPWNAPLILGTRAIAMPLACGNTVVLKASEICPALHSLIGAVFEEAGFPAGVVNVITNAPADAPAIVERLIAHPAVRRVNFTGSTRVGRLIAEQAARHLKPVLLELGGKNPLVILDDADLDAAVQAAAFGAFFNQGQICMSTERIIVDRAIADRFVERLTDKAGALRAGRPGQDGAVLGGMVDASAAQRIRHLVDDAVGKGARLRTGALRIDGNIVQPAVVDGVTPAMALYGEESFGPVVAVLRAADDEDAIRLANDSEYGLSAAVFSRDIARAMQVARRIESGICHINGPTVHDEAQMPFGGVKASGYGRFGGKAAIDAFTELRWITVQAGARHYPI

SEQ ID NO: 13741 - protein, 492 aa, Ralstonia solanacearum GMI1000
MNAPQAMRFLDDAQWDGLLFQGRWVPPLRRRTADVMEPATGRKLTRVGLADAQDVDAAVEAAAAAQPAWVAMPPRERANVFRRAAMLFEQHFDELALAIARETGAALFKGEHEVREAITLCHVAAGMPLEAQGQVLASPAGRLSYARRAPFGVVGVISPFNFPLFLTLRSVAPALAAGNAVVIKPDLRTPVSGGYVIARVFAEAGLPAGLLHVLPGGAEAGEALVVHPRVPMIAFTGSPGVGRRIGELAGRHLKKVSLELGGANALIILDDADLDLAVSNAAWGAWLHQGQICMAANRILVHASLADALTARLVEKAEHLPVGDGASGQVALGPLIDQKQLQRVHAIVQDSVAAGARLLAGGSYEQLFYRPTVLAGVRPGMRVFDEEVFGPVANIIVFRDDDEAVALANDSQGGLAAGVISASVGRAMALGQRLRVGMVHINDQTVNDDCVNPFGGPGIAGNGTSMGGPADWEEYTQWRWVTVKESAPRYPF

SEQ ID NO: 13742 - protein, 310 aa, Ralstonia solanacearum GMI1000
MLDIQMQSLLQGMQQAGVPDMADLPPPAARQVYSRIMAAAAEPVRAVSIAERTIAGPGGDLALRIYAPQRPDPRRGVALYLHGGGFVVGTPRDYDSVASALCERSGCVVVQVDYRLAPEHPFPAAVEDAWAAACWVAAHARELGAQPRIAVVGDSAGGNLAAVLARLARDCEGPAIVQQTLIYPMVAARPETTASYLRYGTGYTLTTRLTHYFHDLYLNGRPAEGDPRLVPLSAPDASGLPPALVMVAGYDVLRDEGIQYAHRLAQAGTPVTLVEYSGMVHGFIGMAGALEAARQALAQVADAVGRALAG

SEQ ID NO: 13743 - protein, 416 aa, Ralstonia solanacearum GMI1000
MFGWFKEISAGEKRTFWACFGGWALDALDVQMFSLVIPTIIAAWHIGKTEAGLVSGITLVASALGGWIAGAMTDRLGRVRTLQITVAWFSLATFASAFAQNFEQFLALKAVQGFGFGGEWAAGAVLMAESIRASHRGKAMGTVQSAWAVGWGAAVLLYALTYSLVEPDLAWRVMFAAGVLPALLIIYIRRGVQEPAPAGAKAEAGPDGMPVSRFPLLDIFRPRVLRMTLIGALLGVGAHGGYYALMTWLPTYLKTERHLSVLGTGGYLAVIIFAFWCGCVASAWLLDVIGRRGNILLFSCCCVVTVLVYLLVPLSDGAMLVLGFPLGFFAAGIPASMGALFNELYPHGVRGTGVGFCYNFGRVVSAAFPVLVGKMSASMSLGTAIGIDAAIAYSIVAVAVLMLPETRGRDLAAVTA

SEQ ID NO: 13744 - protein, 1160 aa, Ralstonia solanacearum GMI1000
MTRNPTVLLVDDALWYKDAVIYQLHVKSFCDSDNDGVGDFPGLISKLDYIAELGVDAIWLLPFYPSPRRDDGYDIAEYRGVHPDYGTMADARRFIAEAHARGLRVITELVINHTSDQHPWFQRARRAKAGSALRDFYVWSDHDKKYAGTRIIFIDTEPSNWTWDPVADAYYWHRFYSHQPDLNFDNPRVLKAVLGVMKFWLNLGVDGLRLDAVPYLVEREGTANENLPETHAVLRKIRAAMDAEFKNRLLLAEANQWPEDTQEYFGNGDECHMAFHFPLMPRMYMAIAREDRFPITDIMRQTPEVPPTCQWAIFLRNHDELTLEMVTDAERDYLWEVYASDRRARLNLGIRRRLAPLLERDRRRVELMNSLLFSMPGTPVMYYGDEIGMGDNIHLGDRDGVRTPMQWSPDRNGGFSRADPEQLVLPAIMGSLYGYESVNVEAQTRDAHSLLNWTRRLLATRKRHRVFGRGSIQFLQPANRKVLAYARALEGEAPILCVANLSRASQAVELDLAAYAQRVPVELIGGTAFPPIGQLPYLLTLPPYAFYWLELRENEPGPSWAQPAAEQLPEFTTLVLRAGLDALADTRQREAHRQLVEREILPTYLPKRRWFAAKDSVLRGAHFAWGTELPVDAASTNRPLAGATRPEVFINEIAVTLGDADGTERTERYLLPLSIAWESATLPALPIQLALARVRRGRHVGYLTDAFTTETFARVLLANLVRGVTLEASDGRVHFEPEPHLAELAEPPVAAETAAVRPAPLPLAPDAPVQWLAAEQSNSSLVIGESVIVKLIRRVAAGVHPEVEMTRHLTRIGYANTAALIGEIAHEGADGERSTLAVLQSFVPNQGDAWTWALDYLRRTIDELAVLTEAVSAGDGDAAPTAVSEARTDTDEALAGYLAFIGAIGTRLGELHVALAGPSDDPAFGTRAADADDAAFWTARVDEELARALDHLAAWQAANGPRAEVGWLLSQRDALLEAARERAQGGLGAMLARVHGDFHLGQVLVAQGDAYLIDFEGEPSRPVDERRRKTSPLRDVAGLVRSLDYVVGAMRQGPEHVAGPAQERRDQLLERFRNASTERFLEAYAAAILASGSDDGACMLDLDLLDLFLLEKAAYEVNYEAANRPTWLPIPLAGLARVARRLLPADVAPPVARDPLGGPP

SEQ ID NO: 13745 - protein, 1201 aa, Ralstonia solanacearum GMI1000
MTDPKTFAAPASRTPPATPPRAAEDTQQPAAAQTPTQAPPAATPHARPEAQWSAAAFTPAICYLHPLQQGPLDQWGGLLDRIAALGFDHVLIAPPFAVGAGGNVFVTRDHARLHAALGGGPAHAALGRLADACRQRGLTLLMDLVIDRVATDAPLRADHPGWFHCRAEHGDALDPRLPPSHLEVASFRHDDAHCAEAIGAWWMQQLRAWTALGIGGFRCEAPARLPAARWHPLIAATREGAGARPVRFLAWTPGLDGRAVEALADAGFDATFSSLRWWDFRAGWMVEEHARLAAVAPPIATVEAPFGTRYGQAFGDAMTRERAYRRMLDVADVLGAGWLMPFGFERGALLPMLPDRGDPTDAQWIDAHAAFDLSDAVRDVNATLRAAQAAGTVAARADLRMLTGPDARMSALLRADGPDLRADDAATLLVINPDLHTGVAAQADRFLPGVAGGFTRGVALDLLTEPAGSRDEALRAKARALAEIDLPPGGVQAWRVFRSRPVRWRPIVAPGGQRAIPGDADSGRAGTAVAAPRIAIEHVAPAVDDGRFAVKRLVGDDIVVEADVLMDGHDQLAVELQWRADDDDAWQRVPMVPLGNDRWRGAFRPERLGRHAYAVAAWRDAFGTFRAELETKHAAGVEVAVELEEGAQLVAHAADHAPKDAPVGALHQLADLLRATAPDPAHRLKLLLDPATAHVMAQASHFRPFHVRSAPYPLDVERSGAAFASWYELFPRSASGDAQRHGTFRDVARRLGVIRAMGFDVLYFPPIHPIGRTHRKGRNNSLRAEPDDPGSPYAIGAAEGGHDAIHPQLGTLDDFRRLRDAARGQGLELALDFAIQCSPDHPWLRAHPGWFAWRPDGSVRYAENPPKKYEDIVNVDFYAASAKPALWLALRDVVMFWADEGVRLFRVDNPHTKPLPFWEWMIGEVRARYPDAIFLSEAFTRPKVMYRLAKVGFSQSYTYFTWRHGKQEFIDYLTELTRTPVREYFRPHFFVNTPDINPVFLQTSGRPGFLIRAALAATLSGLWGVYNGFELCEGQALPGKEEYLDAEKYQLRAWDHDRPGNIVAEIALLNRIRRANPALHSHLGVQFQPASGEGILYFSKSTPAPLPTHPAELADAAPERFGDNTLLVAISLDPHHPQEADIELPLWQWGLPDHGALMAENLVDGARFVWRGKRQHVRLAPEQPFAIWRVRPALPSEEQPS

SEQ ID NO: 13746 - protein, 324 aa, Ralstonia solanacearum GMI1000
MAIRDGFSGSIGNTPLIRLARLSEETGCEILGKAEFLNPGGSVKDRAALYIIRDAERRGTLRAGGTVVEGTAGNTGIGLAHLCAARGYRCVIVIPETQSPEKMDLLRALGAEVRPVPAVPYKDPNNYQKIAGRLAQETANAIWANQFDNLVNRQAHYETTGPEIWRDTAGRVDAFVCATGTGGTLAGVARYLKEQNPAVRTVLADPHGSGLYSFVKTGSIQAEGSSITEGIGSTRVTANLEGTPIDDAVRIDDQTCVTMVYRLLREEGLFVGGSTGINVAAAVQLARELGPGHTIVTLLCDRGNLYFARLFNGAWLAQKGLVAG

SEQ ID NO: 13747 - protein, 338 aa, Ralstonia solanacearum GMI1000
MIAKSIVDCIGGTPLVQLARLYDGRKAEVFAKLEMLNPAGSIKDRPARYIIERGLAEGSIAPGTHIIESSSGNLAIALAMVCRIKGLRFTAVVDPKISPTNLKILRCYGAGIERVTRKDSQGGYLETRIERVRQMLASEPGAVWINQYGNPRNWESHFHGEGDEIARALDRPADMLVLGVSTSGTVLGIARRLRREWPGLRVVAVDAVGSVLFGAKPGPRELPGIGASRVPELLCRDDIDDVIHVDDYDAAMGCRRLLEREGIFAGGSSGAVVVAIDRLLARATRPLRIVTLLPDRGERYLDSVYDDEWLARIAASRAGGAVSAASPSLHVPSLEEVL

SEQ ID NO: 13748 - protein, 343 aa, Ralstonia solanacearum GMI1000
MPEKKTYKAMQVTGPGVLEMVERDTPTPAIGEVLIQVEACGICGADAGVIEGREAGLQYPRVPGHEVVGRIVATGPGTASIWRVGQRVGVGRLGGHCNECEQCRRGQFQLCRNQPIVGSTQDGGYAEMMLARSTGLVSIPDTLSSEAAAPILCAGIATFNALRKSGAQAGDLVAIQGIGGLGHMAIQYARRMGFRVVAVGRGTDIVNDVRALGAHIYIDTHIEDPAVRLRELGGAQVILTTITDSAAASPLMSALAPQGRLLVVGVGQAPLAVMPSALVGGERMVQGTLTGSPFESEKALDFSVLTDVRPLIETMPLEKAHEAYQRMMSGQVKFRMVLTMNAG

SEQ ID NO: 13749 - protein, 359 aa, Ralstonia solanacearum GMI1000
MNALFAPVRVGRHTLQNRLAMAPMTRSRAEPDGTPGELAADYYAQRASVGLIVTEGTQPSDDGQGYLTTPGIYTDAHVAGWKAVTSAVHAKGGHLFIQLMHAGRMSHPDNTPHHRPGVAPSAIAPGAPMFTATGMQDIPAPRALTTEEVRRTVDDFRLAARRAIEAGTDGVEIHGANAYLIQQFFAPSANTRTDAYGGSIENRARFAIEVAAAIADEIGADRTGIRLSPGTTMWGIDEGAEGPDLYRYLVAELDKLGLAYLHVMHQGDEPLLADLRRRWKQPLIVNRPGRPREQVGADVASGLADLEAYGQMVLANPDFVARLKAHAPMNEAQRNTFFGGSAPGYTDYPTLGETAGASA

SEQ ID NO: 13750 - protein, 249 aa, Ralstonia solanacearum GMI1000
MSTPLIQIEHVNKSFGAHHVLKDVSTAFHAGQVAVIVGASGSGKSTLLRTLNRLERHDSGRITVDGIEVDDHPRHLEALRREVGMVFQQFNLFSHLSVLDNVTLAPRRTRKIGRKEANDQAMELLRRVGLETHAHKHPFALSGGQQQRVAIARALAMQPRVMLFDEPTSALDPEMVKEVLDVMRGLASSGMTMIVVTHEMGFAREVADRVLFFDRGEIAVDAAPGVFFGKEHANPRVNAFLGRGMLAAA

SEQ ID NO: 13751 - protein, 338 aa, Ralstonia solanacearum GMI1000
MNLNKHPRHPLTFGPTPIQPLKRLSAHLGGKVELYAKREDCNSGLAFGGNKTRKLEYLVPEVLAGGYDTLVSIGGIQSNQTRQVAAVAAHLGLKCVLVQENWVNYADAVYDRVGNIELSRILGADVRLDAAGFDIGIRPSWEQAMEDVRRAGGKPFPIPAGCSEHPLGGLGFVGFAEEVRQQEAEFGFRFDYIVVCSVTGSTQAGMVVGFAADGRADRVIGIDASAKPEQTREQILRIARDTAKLVELGRDITEDDVVLDTRYGGPEYGLPNEGTLEAIRLCARQEGMLTDPVYEGKSMHGMIDRVRGGEFPEGSRVLYAHLGGVPALNAYSFLFRNG

SEQ ID NO: 13752 - protein, 298 aa, Ralstonia solanacearum GMI1000
MKIAFIGLGNMGAPMARNLLKAGHALSVFDLDARAVQSLVDAGASAAPSPKAAATGADCAITMLPAAAHVHSVLTADDGILAGIAKGVPIIDSSTIDPDSAKALAALATAHGNPFVDAPVSGGTGGAAAGTLTFMVGGGAAVFEQVRPVLSAMGKNLVHCGEAGAGQGAKICNNLVLGITMAGVAEAMSLGEALGIDPKVLGGIINTSTGRCWSSDTYNPFPGVIETAPSSRGYTGGFGTDLMLKDLGLAGDAAKSVRQPVYLGALAQQLYQASSSQGAGKLDFSAVIRLYRPAGAAR

SEQ ID NO: 13753 - protein, 418 aa, Ralstonia solanacearum GMI1000
MDAHVNTSVPDTGAPVACPARTSGDAWKALAGSAIGYAMDGFDLLILGFMLPAISAALALTPGESGALVTWTLVGAVAGGILFGALSDAYGRVRVLTWTIVLFAVFTGMCAFAQGFTDLLIYRTIAGIGLGGEFGIGMALAAEAWPAHKRARVSSYVALGWQCGVLLAALLTPLLLPFIGWRGMFLLGVLPAAVAWFIRNRLHEPELFVRHAHAPRGKTSAFRLLVSDARTLRTSLGIVILCAVQNFGYYGIMIWLPTYLGKTLGFSLTKSALWTSVTILGMMLGIVAFGHLADRIGRKPTFLIFQAGAVAMVLTYARLTDPLALLWAGAVMGMFVNGMIGGYGALISEAFPTAARATAQNVLFNLGRAVGGFGPVVVGSLAAAYSFRTAIALLAGLYVLDMLATMALVPERKGAELA

SEQ ID NO: 13754 - protein, 301 aa, Ralstonia solanacearum GMI1000
MVIWLRREAALGVSSDVIRAADRHRVVELDAAVQAVYEERDAVLAAARAKAEAIVAQARAVADDLIKDANERAANSEQLGYAEGQRKALAEFHASMVARAYSEAESTRRVEARLQTAVMQAVERIVLESDRQALFARVASTLGGVLQSQARLTLRVCPAELDAARAAFARAVEGGLLNATVEVLADDSTKPGDCRCEWDHGVADASLSVQLAALRKAIAPSASVPAEAAQPAAAEDEEEDADIDAPDEYEYDYDDSEDEEDEDAVSHEDGEDEEDDDSDDDDEDEDLYEEDDEDEDEEDDE

SEQ ID NO: 13755 - protein, 491 aa, Ralstonia solanacearum GMI1000
MGTVSVEPGSYRAEPPRNPGEVIDLIRQRAVQVVDLRFTDLPGLWQHFSITLPEVNDELFEAGIGFDGSSIRGFQEIHESDMLVRPDPATAFIDPFCETTTLALICDVIDPVLHQPYSRDPRHIAKKAERHLQHSGIATTCYFGPELEFFIFDSIRFGQDQHSGYYHVESAEGEWTSGRDEGAYGGGNLGYKQRYKEGYFPVPPHDTLQDIRSEIVLALMQAGIRVEVHHHEVATAGQNEIDMRFAPLTRMADNVMMYKFICKNVARRHGKVATFMPKPLFADNASGMHCHQSLWKDGENLFYDAGGWALTSQLCRWYIGGLLKHAPALMAFCAPSTNSYKRLVPGYEAPVNLAMSQRNRSAAARIPMYSDAPAARRVEFRCPDPSANAYLAFAAMLMAGLDGIAHQTDPGEPLDRNIYELPPEEAEKIRQVPGSLEESLEALEADSYFLRKGDVFTDDVIRTWIDYKRTREIDTLKLRPHPWEFYLYFDI

SEQ ID NO: 13756 - protein, 488 aa, Ralstonia solanacearum GMI1000
MIQNFINGAYREGRAGKRFRDLDPCTGRLVAEVSEAGKEDVDDAVQAARAALNGPWGKLTLAQRCDLLYAVADEIDRRKEDFLAAEVADTGKPRALASHLDIPRGAANFRVFADAVRNVATECFTGTAPDGKPSLNYALRRPKGVIAVVCPWNLPLLLMTWKVGPALACGNTVVVKPSEETPATAALLGEVMNAVGVPAGVYNVVHGFGPDSAGEFLTRHPDVDAITFTGETRTGAAIIKASADGIKPVSMELGGKNPALVFADADLDAVIAGLKRSVFENTGQVCLGTERVYVERPMFDKVVRALAEIAGTLRPGLPGDPHANFGPLISGEHQRKVLGYYALARDEGATVHYGGGVPDMPPDLREGAWIEPTVWTGLPRDSRVLTEEIFGPCCHVEPFDSEEEAVRLANGTPYGLATSLYTGDVNRAHRVSAKLKVGVVWVNTWFLRDLRTAFGGSGKSGIGREGGVHSLEFYTELSNVCLKLEPQA

SEQ ID NO: 13757 - protein, 458 aa, Ralstonia solanacearum GMI1000
MNALPARADVPVREVIDGSRLSAYQGLVLALCFAAAMLDGFDTAAIGYIAPALREAWHLTPPQLAPAFGAGLFGLMLGSMGLGPVADRFGRKPVLLMSVLVFGVATLACAASDSLNTLVMLRFLTGLGLGGAMPICITLSAEYSPQRHRMLLVTLSWSGFTSGLALGGLVAAEILPVYGWRGVLVAGGVTPLVLLPVLALWMPESVQFLAQRPQCADALRQIVTRIAGHDHGDGVTFIGDRPAQEGAPFPGRNLFSDGMAQRTVLLWAAFFCSLFVFYLLTSWLPVVMRDQGLTLTEAARVGAMVPLGGTIGAIALALLMDRAGSPRALIAAYFCGAIAVAAIGLAIGNVAALTAVVFVVGFGIAGAQNGINLLAAQMYPTEARATGVSWALGVGRGGSITGSLVGGTLMTTVGSVQTLFGIIALPALVASLALFALLLRPAAGQTGAGRPGNGASLV

SEQ ID NO: 13758 - protein, 331 aa, Ralstonia solanacearum GMI1000
MRPSVLVTRATFPDIANRLREHFDVTDNPSDAILSPSELIARLQGKQGVMSTGSERIDAALLDACPQLKAVCNVGVGYNNIDVAACTARGVVVSNTPDVLTQTTADFGFALMLATARRITESERFVRRGEWQKTGIHDQMLGSDIYGATLGILGMGRIGQAIARRAALGFEMQVIYHNRSPLEAETEARAHARYVDKDTLLRESDHLILVLPYSPEAHHTIGAAELARMKPTATLTNIARGGIVDDAALAQALRQGTIAAAGLDVFEGEPRIHPDLLALDNIVLTPHIGSASVNTRRAMAALTVDNLIAALGYGPRAGQPPTPVNPQVLQQ

SEQ ID NO: 13759 - protein, 445 aa, Ralstonia solanacearum GMI1000
MKPAPHPLETTDLSYFWMPFTANRQYKAAPRLLVSAQGMYYRDADGREVLDGTAGLWCVNAGHCRKAIVDAITAQAAAMDFAPTFQMGHPVAFRAAEKVAEIMPAGLNRIFFVNSGSEAVDTALKIALAYHRARGEGQRTRFIGRERGYHGVGFGGISVGGIAPNRKAFSANLMPGVDHLPHTHAPEHNAFSKGQPAWGAHLADELERIVTLHDPSTIAAVIVEPLAGSTGVLVPPKGYLERLRALCDKHGILLIFDEVITGFGRLGAATASAFFGVTPDLLTMAKGINNAAVPMGAVAVRQSLHDAVIEAGAPGAIELFHGYTYSAHPLAAAAAVAAIDLYRTEGLFERARALSPAFEAAAHSLKGAPHVKDIRNLGLVAGIELEPRPGAVGARAYEVFLKCLERGVLVRYTGDTLAFSPPLIISEAEIARIFDTVRTVLQEVA

SEQ ID NO: 13760 - protein, 262 aa, Ralstonia solanacearum GMI1000
MSRIASPASSARAAPLPPIDPARTAFLLDFDGTLVDIAPQPEAVHVAPDLRATLAALQRASGGALAVISGRTVADLETRLDLPGLVIAGVHGAERRHADGSFHRLQTDSEALAALERELRAQLPSVPGVVLESKGIAFALHYRHLPQAADAVCALARRLADRYADHVRLQAGKMVVELKPRGASKGAVVGHLMRAAPFAGRIALFAGDDLTDESAFEAVNTLGGWSIKVGMGPSQAHWRVPDPAALRDWLAALARRAGGRAA

SEQ ID NO: 13761 - protein, 357 aa, Ralstonia solanacearum GMI1000
MGSSPPRLVVSEHAPAAAADTGTRAAPRHPLAGVPDAVPAGALRVAAADQPGPGTDAPATAEANTPPRAVSAADYWTQGYASRIRLRVFRPERRADDGAVPLRQPGVLYLHGGGFVGGCIDDADVSARHLAATLPAVVVTVGYSLAPAAPFPAAPEDVYAALCCMAEHAATWGIDRRRLAVAGHDAGGNLSAALAMIARDRGGPGLRAQVLIAPMLDPTMARVRPDRLADADNSAEACAACYRQYLPRPTERVHPYAAPVESRRLHGLPPALLLTAPQDLLRTEAERYASALIEAGVATQVLRVADACHDSIATDRAALDEITCFLRWHLGLTRPAGPRKRRRRRAATAGTADELPG

SEQ ID NO: 13762 - protein, 306 aa, Ralstonia solanacearum GMI1000
MSARNGFTEADVPDQSGKGFIVTGANTGLGLETSRVLAARGARVLLACRDRSKAEAAMAHIRQTHPGADLAFLPLDLADLASVRAAAGQAMTAPRIDALINNAGVMMPPLMRTTQGFELQLGVNHLGGFALTALLLPKLAQTPGSRVVVTSSLAHRGASIDWDDLSAATRYNRVKRYGASKLANALFFFELDRRLRASGSPVTAVGCHPGAAVTDLVRYMGALQLLQPLVRRFLNTAAMGAWPTLQAATGPVQPGGYYGPTGLRGIRGPSGRATRSAQAQDPLLAQRLWDVSIAMTGIDPGLPVEN

SEQ ID NO: 13763 - protein, 355 aa, Ralstonia solanacearum GMI1000
MPHAVKSYAAHSPTGRLGLFEFDRRSPRPDDVVIEILYCGVCHSDVHNVRNDWGSARYPMVPGHEIVGRVLEVGAEVTRFKAGDPVGVGCMVESCRHCNACGKGWEQYCENGATYTYNGTDPIDGTRTYGGYSEKIVVAEHFVLKMPEGLDLAGAAPLLCAGITTYSPLRHWNVGAGSQVAIVGLGGLGHMGLKLAKAMGAEVTLFSRSPGKEADARRLGADHIVISTDAAQMATVAGRFDLIIDTVPYQHDVNPYVPTLATGGTIVMVGYLGPLEPPLNSGPMVYRRKALAGSLIGGIAETQAMLDFCGAHGVTSDIEVIRIQDINEAYERMLKADVKYRFVIDMASLKAAAAA

SEQ ID NO: 13764 - protein, 304 aa, Ralstonia solanacearum GMI1000
MDYQAILETIHRDIQPWLGKGRVADYIPELAKASATDFGMAIVTPRGEVFRVGQAETLFSIQSISKLFACTLAFQLEGESLWQRVGREPSGNAFNSLVQLEHENGIPRNPFINAGALVVTDVLCRRFVQAETAMVQFMRRLVDNPRVDYNPRVALSELEHADRNRAMAHFMRSFGNLHMPVETVIDAYCRQCAIEMHCVDLARAVLFLANGGVVPWSGERVIETSPAKRLSALMLTCGTYDAAGDFVYRVGLPAKSGVGGGIVAVLPGEFGVCVWSPGLDVSGNSLAGLQALEWLTTLSGRSIF

SEQ ID NO: 13765 - protein, 309 aa, Ralstonia solanacearum GMI1000
MADILAYGEALIEFNQTDPGSAAWALGYGGDTSNFCIAAARQGARTGYVSAVGADRFGQALRTLWQAEGVDHTWVQTDLQAPTGLYFVSHDARGHHFDYLRAGSAASRFQTAQLPLQAIAAARVFHLSGISLAISDTACDAGLAAMAHARAAGVTVSFDTNLRLRLWPLARARAVMREAMRTCDLCLPSWDDVTVLLDCHDRDAIVDTLLGWGIRLVALKMGVEGCYVATPEARTLVPRHPVAAVDATGAGDCFGGAFVARIVAGDTPQDAARYANVAAALSTTGYSAVAPIPRAEAVRAALAGAAAAL

SEQ ID NO: 13766 - protein, 409 aa, Ralstonia solanacearum GMI1000
MSRAARPKLVVIGNGMAGMRTVEELLKLAPDLYDITVFGEEPHGNYNRILLSPVLAGEKRVDDIMLNTREWYEEHGITLHAGDPVVAIDRPRRTVRSRGGVEVRYDRLLMATGSRPFILPVPGHMLPGVIAFRDIQDVETMLDAARNHRHAVVIGGGLLGLEAANGLMRQGMEATVVHISDTLMERQLDKPAAALLKVALEAKGLRFLLGAQTTELIGTDRVTAVRFKDGTEIPADLVVMTAGVRPNIELARSAGLHCERAIVVDDTLQTYDPRIYAVGECVQHRSATFGLVAPIWDQARVCAAHLAGAGHRRYVQQATATKLKVTGVDLYSAGDFIGGDGTEDIVLRDPRRGVYKRLVLKDDRIVGAVLYGDVADGPWYFELIQRQAPIAAMRQRLLFGRALCEAEAA

SEQ ID NO: 13767 - protein, 441 aa, Ralstonia solanacearum GMI1000
MTGKATRIDLFSLRTPQMRAFHLTWLAFFVCFYAWFACAPLMPVLKGEFHLTPGQIANINIAAVAVTILVRLIVGPLCDRFGPRKTYTGLLVLGAVPVLGVALAQSYEAFLFFRLAIGAIGASFVITQYHTSVMFAPNVVGTANAAAAGWGNAGGGVAQGTMPLLLTAIVMLGVTQGMGWRLAMVVPGVAMLIVAVLYWRYTQDCPEGNFDDLRAAGKTIEGGKKGGWGSFVTAAGNYRVWLLFVTYGACFGVEIFIHNIAAIYYVDHFGLSLSAAGMAAASFGLLALFARALGGIVSDRVARSRGLDARTLLLCVLMVGEGLGLLGFAHAGTASLAVLAMLGFGLFTHMACGATYALVPFIDRRALGGVAGIIGAGGNVGAVAAGFLMKGLGDAQQTLSVLGVMVMLSAICAVAVRFSAEHKAREQALYDNTLAAGAANV

SEQ ID NO: 13768 - protein, 307 aa, Ralstonia solanacearum GMI1000
MLTTMNLPQLVVFGEALTDFIREADGRWRSVAGGSCWNVARVCARLGAPTGFAGTVSRDVFGDELTALSRQAGLDMRFMRQVARPPLLAMVPAAHPPQYFFIGENSADLAFDTGVLPDGWIEAAQIVHFGSLSLARQPLAAHLLETATAVHAAGKRIAFDPNYRDAMAGPDYRPTLRRMAGLASYIKVSDEDLRGLFPELDETSALAQLRAWAPTAAILMTRGAAGMTLITPEGTLFQPALPTLVADTVGAGDASMGGWLASLLTRPEAMPASHLEFSAASAAAVCARQGAYAPTREEIVSALAVSR

SEQ ID NO: 13769 - protein, 510 aa, Ralstonia solanacearum GMI1000
MNRGNALLVLAVFVVASCGLAYELIAGALASYLLGDSILQFSSIIGAYLFAMGIGSWVSRYVADDALLARFVDLELLVGLFGGVSAAALFLLFALESAPFRLVLYALVTVIGVLVGMEIPLVMRMLHRRQAKFSDLVSRVLTFDYLGALAVSLLFPLVLAPRLGLVRTGFLFGLCNTAIAVWTLWHFRAELGLSARLRGAMAWRAGMVGAALLAGFAASDRLTHWSERALFGDEIIHAISSPYQRLVVTRWKDDLRLYINGNLQFSSRDEYRYHEALVLPALESVRGARRVLVLGGGDGLALRQILKYPQVEHVTLVDLDPRMTSLFSHAEALVALNQHAFSDPRVTVVNADAGQWLQTAADMFDVAIVDFPDPSNFSIGKLYSVPFYRLLSRHVADTGLVVIQATSPYFAPRSYWCVDATLKEAGYRTWPYHALVPSFGEWGFILAAPGRADFRPPTTYRVPTRFLDADTTHQMFSFAPDMPRPQVEPNRLNNQSLVRYFEEDWHGVLR

SEQ ID NO: 13770 - protein, 459 aa, Ralstonia solanacearum GMI1000
MTQRFDAIIIGTGQSGPPLAARLSGAGMKVAIIERGRFGGTCVNTGCIPTKTLIASAYAARLAQRAGEYGVVIGGPVTVDMKRVKARKDEISGHSSQGVEQWLRGLEHGTVYQGHARFESAHAVRVGDARLEAERIFINVGGRALVPPMPGLDQVPYLTNASMMDVDFLPAHLIVVGGSYVGLEFGQMYRRFGARVTIVEKGPRLIQREDEDVSQAVREILENEGIDVQLGADCLSARRDADSVIVGLDCATGAREVAGSHLLLAVGRVPNTDDLGLDRAGVETDARGYIRVDEQLRTTVPGIWALGDCNGRGAFTHTSYNDYEIVAANLLDHDARKVSDRIPAYAMFIDPPLGRAGMTQAEAVQSGRRLLVGTRPMTRVGRAVEKGESQGFMKVIVDADSGAILGASILGVTGDEVIHALLDTMYANAPYTTISRAMHIHPTVSELLPTLLQALRPLG

SEQ ID NO: 13771 - protein, 434 aa, Ralstonia solanacearum GMI1000
MDVFSEFESEARSYCRRFNATFDKAKGSYIYGNAGKRYLDFLSCAGALNYGHNPAGLKAALLAYLADDGIQGALDLHTEAKRAFIEAFTRHILAPRGLGYKMQFTGPTGTSVVESAVKLARKVTGRQTVAAFTNGFHGMSGVSLGLTGARYHRQATQDPHVVRLPYDGYMPGLDGMAYFRRLLEDASSGVDLPAAVVVETIQGEGGVNVASRQWLRSLRELTRAFGILLIVDDIQAGCGRTGTFFSFEFAEIEPDLVCLSKSLSGYGLPLSVLLLAPRHDIWAPAEDNGTFRGNSLAFVSATAAIEQFWRDDALQRAIGEREQQFAGFATALVAEHGALIKAIRGRGLFQGIEFHDPGHARKVAEACFAQGLLIERCGAEDQVLKIMPALTIDADVFQQGLQIIRQAFGELARQRESGAAAAAKGGANQPVALA

SEQ ID NO: 13772 - protein, 472 aa, Ralstonia solanacearum GMI1000
MQRSSHAKIVATLGPASDDHATIEALARAGADVFRLNFSHGAHADHQRRLERIRAVEAALGRPLGVLLDLQGPKLRVGTFAEGRVRLDDGAPFRLDLETGRPGDATRVALPHPEIFAAIRPGVALLLDDGKLRLEVVACGPDHAETRVVNGGMLSDRKGVNVPGVVLPLSALTEKDRADLAFGLALGVDWIALSFVQRAADIAEIRQLVHGRAGIVAKLEKPAAIDSLDAILAETDAVMVARGDLGVELPAEQVPAIQKRIVRACRRLGKPVIVATQMLESMIGAPVPTRAEASDVATAVYDGADAVMLSAETASGQFPVEAVAMMRRIIAQTEADPHYRAAIDASHTPPGANTPDAIGCAAHSVAGLLDVAAMVAYTSSGASALRMARERPRAAILGMTPRPETARRLALVWGVHPVICDGVLDVEAMTDVARQTAVQRRFAQAGQTLVIAAGLPFGTPGSTNLLRIAQVE

SEQ ID NO: 13773 - protein, 318 aa, Ralstonia solanacearum GMI1000
MSTYTTAPRTGHQTLLYAELDTDLDNLQADIAVLGMPFGTPYSAADFSNDQTNAPAAIRQATDRVARAPGHYDFDIDGPLLQGRDDIRFVDCGDIVPDLAQPPGEHYARAEAAVRRLANAGALPIVLGGDHGITTPILRGLDQKGPITLVHIDAHLDWRDSVNGVKEGLSSPMRRASEMPHVARIVQIGLRAQGSGRPEDLAAARAYGADLITAYELHDIGMDAVLARIPDGGNYYITIDADGLDPSTMPAVAGPAPGGLTFAQTRKLIHGLVRKGRVVGMDIVEIQPKKDINQISCITAGRLILNLIGTTIRAGYFD

SEQ ID NO: 13774 - protein, 423 aa, Ralstonia solanacearum GMI1000
MARFRASFPPAIMTGLTTALLHADREAGIEHYAVHKPLHTSTTYGYADTRDLIDVFQGKPGYTYARQGNPTTAALEAKITMMEDGLATACFATGMAAIAAVFSTLLRAGDHVVSSAFLFGNTNSVFETLRNLGVEVTFVDATSAQAVADAVQPNTRLVFVETIANPRTQVADLGGIGALCKARGLLYVIDSTMTSPWLFRCRDAQAGLVVHSLSKYIGGHGNALGGAVVDTGLFDWTAYPNIFPAYRKVKPEMQGIQQIRKKGLRDLGATLIADAAHRIAIGAETMALRVDRTCSNALALARTLAAHPKVARVYYPGLADHPQHARATELFRHYGGLLSFELVDGADYVDMLNHLRYAVRATHLGDTRTLVIPVAPTIYWEMGAERRASMGIADSLVRVSVGIEDEVDLLADFTQALDATGIR

SEQ ID NO: 13775 - protein, 493 aa, Ralstonia solanacearum GMI1000
MALTFDQLRHTGLIRTDNLIDGRWSAGADGARYAVTDPATGSIIAQVADSSAADARAATDAAARALPAWRDTLPAERAAILRRWHAAIVANADALGRLISLEQGKPFAEGRGEVMYGASYVAWFADEATRIYGDLIPQQQRGKRMSAIKEPIGIVAAITPWNFPLAMIARKIAPALAAGCTVVAKPAEDTPLTALALAQLAQEAGLPPGVLNMIAASRERGVAAVADWLQDGRVRKITFTGSTPVGKHLARESAGTLKKLSLELGGNAPFIVFDDADLDAAIAGLLSAKFRNGGQTCVCPNRVYVQAGVYDRFAAMLAARVSALKVAPATDPDAQIGPMINARAVDKIERHVQDAVAHGARVLAGGKRLPEVGAHFYAPTVLADAHPGMALCGEETFGPVVPLFRFTDEAEAVQAANDTPFGLAAYFYSQDVRRIDRVAHALEAGIVGINEGALASEAAPFGGVKESGYGREGSKYGLDDYLSIKYLCQGGLA

SEQ ID NO: 13776 - protein, 434 aa, Ralstonia solanacearum GMI1000
MSWLARFFKLEEHQTDVRTEVVAGLTTFLTMAYIVFVNPNILADAGVPHDAVFVATCVAAAIGTAIMGLYANYPIAMAPGMGLNAYFAYSVVKGMGFTWQAALGAVFVSGCLFMLVSLFRIREMIINGIPHSIRIAITAGIGLFLGIVSLRGAGLVVGNPATLVALGDVHQPSVILAVIGFFLIVTLDHLRVKGAILIGILAVTVASFFVAGNTFHGVVSMPPPIAPTLLQLDIQGALSVGILNVVLVFFLVELFDATGTLMGVANRAGLLKAGRMDRLNKALLADSTAIVAGSMLGTSSTTAYIESAAGVQAGGRTGLTALTVAVLFLACLFIAPLAGVVPAYATAPALLYVSCLMLRELVELDWADTTESVPAVLTALMMPFTYSIANGVAFGFVTYSGLKLFGGRWREVPAVVWIISLIFLFRFFYLQAGH

SEQ ID NO: 13777 - protein, 280 aa, Bradyrhizobium japonicum USDA 110
EFRNREALAPRQFAIVILQSGETADTLAALRYAKGKGLHTISVVNVPTSTIARESESVLPTLAGPEIGVASTKAFICQLMVLGVLAVRAAKERGKLSEIDESQLVRELIEVPRLIAAALLVEPQIEKLARYIAGARTVLYLGRGTSAPLALEGALKLKEISYIHSEGYAAGELKHGPIALIDEAVPVVVIAPYDEVFEKTVSNMQEVAARGGKIILITDAKGASEAMVDTLLTIVLPAMVASFTPLVYAIPVQLLAYHTAVARGADVDQPRNLAKSVTVE

SEQ ID NO: 13778 - protein, 380 aa, Washingtonia robusta
MSSTAGKVIKCRAAVAWEAGKPLVIEEVEVAPPQAMEVRMKILYTALCHTDVFFWEAKGQNPLFPRILGHEAGGIVESVGEGVTDLAPGDHVLPVFTGECRECAHCLSEESNMCELLRINTDRGVMINDGKSRFSINGKPIYHFVGTSTFSEYTVVHSGCVAKINPLAPLNIVCILSCGISTGLGATLNVAKPTKGSTVAVFGLGAVGLAAAEGARLAGASRIIGVDLNPRRFHEAKKFGVNEFVNPKDYNKPVQEVIAEMTNGGVDRSIECVGNIDAMVSAFECVRDGWGVAVLVGVPHKDAMFKSHPVNFLNERTLKGTFFGNYKPRSDLPAVVEMYMNKELELEKFITHEVPFSEINKAFDYMASRGQLRCIIRMDG

SEQ ID NO: 13779 - protein, 306 aa, Washingtonia robusta
  misc_feature (10)..(10): Xaa can be any naturally occurring amino acid
  misc_feature (300)..(300): Xaa can be any naturally occurring amino acid
IVESVGEGGXDLSPGDHVLPVFTGECKECAHCKREESNMCDLLRIDTERGVMISDGQSRFSINGKPIYHFVGTSTFSEYTVIHSGCVAKINPLAPLDKVCVLSCGISTGLGATLNVAKPPMGSTVAIFGLGAVGLAAAEGARIAGASRIIGVDRNPARFDEAKNFGITEFVNPKDYDRPVQEVLAEMTGGGVDRSIECTGNINAMISAFECVHDGWGVAVLVGVPHKEAEFKTHPINFLNERTLKGTFFGNYKPRTDLPLVVEKYMNKELELEKFITHSVPFSEINKAFDYMLKGDGLRXIIHMDG

SEQ ID NO: 13780 - protein, 394 aa, Penicillium janthinellum
MVVFSKITVVLAGLATVASAVPTGTSRKSTFTVNQKARPVAQAKAINLPGMYASALSKYGAAVPASVKAAAESGTAVTTPEANDVEYLTPVNVGGTTLNLDFDTGSADLWVFSSELSSSESTGHSLYKPSSNATKLAGYSWSITYGDQSSASGDVYKDFVVVGGVKASPQAVEAASQISQQFVNDKNNDGLLGLAFSSINTVKPKSQTTFFDTVKGQLDSPLFAVTLKHNAPGTYDFGFVDKNKYTGSLTYAQVDSSQGFWSFTADGYKIGSKSGGSIQGIADTGTTLLLLPDNVVSDYYGQVSGAQQDSSAGGYTVPCSAQLPDFTVTIGSYNAVVPGSLINYAPLQSGSSTCFGGIQSNSGLGFSIFGDIFLKSQYVVFDANGPRLGFAPQA

SEQ ID NO: 13781 - protein, 491 aa, Musa acuminata
GTRRDRERERERERERERERERERERERERERERERVHLLGSSSLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVPVHREYALCLMATKYDATTA

SEQ ID NO: 13782 - protein, 507 aa, Musa acuminata
MALPPLLLSPLPSLLVVLALLSSLLLAGRKARGGSATWKLPPGPPKLPVIGHLHLLGSSLLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVTVHREYALCLMATKYDATTA

SEQ ID NO: 13783 - protein, 275 aa, Musa acuminata
HEVDWLRGMRSRLERAYVKLDSIYQRLIDYHQDRFRLQGKEDEDILDALLRMQKDEEGVTEDHIKGVLMNIIIAGTDTSTATVLWTMAELIRQPELMKRAQDEVRGCVRSKGEVEESDLDQLHFLKCVIKETMRLHPPVPLLLPRETMQHFKLNGYDILPKTWMYVNAWAIGRDPNSWARPHVFDPERFMHDSTEASGQDFKLIPFGEGRRICPGKNLGMLMVELVLANLIYSFDWHLPPGMVKEDISMEEAAGFTMNREYALCLMATKYDSPTA

SEQ ID NO: 13784 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 13785 - protein, 468 aa, Azorhizobium caulinodans
MKTAKEVLDFIKSNDVKYVDLRFTDPRGKWQHVTFDITMVDEDFFAEGQAFDGSSIAAEAINESDMLLMPDVTTACVDPFFSETTLSVVCDVLEPTTGEPYGRDPRGIAKKAMAYLQSTGIGDTVFFGPEAEFFIFDDVKFKADPYNTGFKLDSIELPTNGDTDYEGGNLGHRIKTKGGYFPVPPLDSAQDMRSEMLASMAKMGAKVEKHHHEVASAQHELGLKFGQLVTMADHLQVYKYCIHQVANIYGKTATFMPKPVYGDNGSGMHVHQSIWKDRKPLFAGDKYADLSQECLWYIGGVIKHAKSLNAFTNPLTNSYKRLVPGYEAPVLLAYSARNRSASCRIPYTNNPKAKRVEVRFPDPGANPYLAFSALFMAGMDGILNKIDPGSAMDKDLYDLPPAELKQIPTVCCSLREALESLAKDHDYLLKGDVFQKDFIESYIDLKMQEVARFEMTPHPVEFEMYYSV

SEQ ID NO: 13786 - protein, 466 aa, Fusobacterium mortiferum
SFPKNFLWGSATAAYQVEGAWNQDGKGPSIWDLYSKLPGTTFEGTNGDIAADHYNRYKEDVKTMAEMGLKTYRFSIAWTRIFPEGSGKINEKGIEFYSNLIDELLKYNIEPMITLYHWDLPQALQDKYAGWESREIIDDFVEYARVCFKNFGDRVKYWIVMNEPNVFIGLGYGIALHPPGGKDRKKELNAGHITALANAKAIKLFREIVPNGMIGSSIAYGPAYAASESEEDKLALEKYYNYNVWWWFDPYFKGEYPADMLKYNQEKYGAPEILDGDMELLKSAKSDFIGINYYCTQMIADNKEGVGYNGMNTTGEKNSQKENGVPGLFKNVRNTNLEYTDWDWAIDPDGLRYGMVQLKERYNLPIIISENGLGAVDPIDEEGNIQDIPRIDYLREHIIACEKAIEEGVDLLGYCTWSYIDLLSWLNGYKKQYGFIYVDRKNNLERKKKASYFWYKDVIASNGEKL

SEQ ID NO: 13787 - protein, 355 aa, Dianthus caryophyllus
NSTKIAPSRVETLASSGIECIPKEYVRPEEELTSIGDVFEEEKKDDGPQVPTIDLKDIASEDPEVRAKAIHELKKAAMEWGVMHIVNHGISEELINRVKVAGETFFEFPIEEKEKYANDQDSGNVQGYGSKLANNASGQLEWEDYFFHLAYPEEKRDMSIWPKSPEDYIPAVSEYSKELRSLATRIFSALSVALGLEEGRLEKEVGGLEELHLQMKINYYPKCPQPELALGVAAHTDVSALTFILHNMVPGLQLFYEGKWVTAKCVPNSIIMHIGDTIEILSNGKYKSILHRGLVNKEKVRISWAVFCEPPKEKIILKPLLDLVNESDPAQYPPRTFAQHIQHKSSERLRMSNPQ

SEQ ID NO: 13788 - protein, 465 aa, Adenia digitata
LGFKAGVKDYKLTYYTPEYNPKDTDILAAFRVTPQPGVPPEEAGAAVAAESSTGTWTTVWTDGLTSLDRYKGRCYDLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIRSAAKWSPELAAACEVWKEIKFEFPAMDTL

SEQ ID NO: 13789 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 13790 - protein, 466 aa, Dovyalis rhamnoides
SVGFKAGVKDYKLTYYTPNYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFLAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNRPGAVANRVALEACVQARNEGRDLAREGNEIIREASKWSPELAAACEVWKEIKFEFQAMDTL

SEQ ID NO: 13791 - protein, 466 aa, Hymenanthera alpina
SVGFKAGVKDYRLTYYTPDYETKDTDILAAFRVTPQPGVPPEEAGAAVAAESSTGTWTTVWTDGLTSLDRYKGRCYDIEPVVGEENQYIAYVAYPLDLFEEGSVTNMFTSIVGNVFGLKALRALRLEDLRIPVAYTKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRKAAKWSPELAAACEVWKEIKFEFQAMDTL

SEQ ID NO: 13792 - protein, 139 aa, Hordeum vulgare subsp. vulgare
MEYQGQHGHCTDKVRSTGQPVAGHGFTGGPTGTHGAAGVGGAQLQATRDGHKTDGVLRRSGSSSSSSSEDDGVGGRRKKGMKEKIKEKLPGGAHKDARAGQQQQTAMAGEIAGTHGTEATGEKKGVMDKIKEKLPGGQH

SEQ ID NO: 13793 - protein, 422 aa, Linum usitatissimum [sequence omitted]

SEQ ID NO: 13794 - protein, 465 aa, Margaritaria tetracocca
VGFKAGVKEYKLTYYTPDYETKDTDILAAFRVTPQPGVPPEEAGAAVAAESSTGTWTTVWTDGLTSLDRYKGRCYHIEPVAGDENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHVHAGTVVGKLEGEREITLGFVDLLRDDYVEKDRSRGIFFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13795 - protein, 466 aa, Ouratea duparquetiana
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHVHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFQFEAMDTL

SEQ ID NO: 13796 - protein, 1224 aa, Sinorhizobium meliloti
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAERPVRIPDTATRDALIRDKIADGNWKSHLGRSRSLFVNAATWGLVVTGKLTSTVNDRTLAARVTRLISRCGEPVIRRGVDMAMRMMGEQFVTGETIEALKRSKELEEKGFSYSYDMLRERPTAADAERYYRDYESAIHATAKPRGRGIYEGPGISIKLSALHPRYRQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYMPRTQAACRDRCGVPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAVLFGDARTNSAGFDLSNEETLASLTEALRESAAMKWTALPQFATGPAAGETRTVLNPGDHRDVVGSVTETRKRTHGAPCACRRRGAGLGGRLAERAACLDRAAELMQARMPTLLGLIIREAGKSALNAIAEVREAIDFLRYYAEQTRRTLGPATPLGPIVCISPWNFPLAIFTGQIAAALVAGNPVLAKPAEETPLIAAEGVRILREAGIPASALQLLPGDGRVGAALVAGRDAGVMFTGSTEVARLIQAQLADRLSPAGRPVPLIAETGGQNAMIVDSSALAGQVVGDVITSAFDSAGQRCSALRVLCLQEDVAGPHPDDAEGRAARHCISAAPIVFSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEVEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 13797 - protein, 318 aa, Haloferax lucentense
MTAELVTFGETMIRLSPPAGERIETARSLEFRTAGAESNVAVAASRLGCSAAWLSKLPDSPLGRRVTTELRTHGVEPYVRWDDDARQGAYYIEQGRAPRPTNVIYDRADAAVTTARPDELAVDIVEDAAAFYTSGITPALSETLRETTGELLQTATEAGTTTAFDLNYRSKLWSPSDARDACESLFPKVDVLVAAERDIRTVLELDGDAPTLASELAGDFDFETVVVTRGEDGALARHGGTVYEQPVFETDTVDAIGTGDAFVGAFLSRLIADEPVETALAYGAATAALKRTVHGDLAVVTPDEVERVLRGGDAGIDR

SEQ ID NO: 13798 - protein, 233 aa, Escherichia coli
MVSFIAFSKNSTHFKGIFAMRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRADLEKILG

SEQ ID NO: 13799 - protein, 457 aa, Vibrio cholerae non-O1
MHRYKKEASNLIKLATPVLIASVAQTGMGFVDTIMAGGVSAIDMAAVSIAASIWLPSILFGVGLLMALVPVVAQLNGAGRQHKIPFEVHQGLILALLVSIPIIAVLFQTQFIIRFMDVEEAMATKTVGYMHAVIFAVPAYLLFQALRSFTDGMSLTKPAMVIGFIGLLLNIPLNWIFVYGKFGAPELGGVGCGVATAIVYWIMLLLLLFYIVTSKRLAHVKVFETFHKPQPKELIRLFRLGFPVAAALFFEVTLFAVVALLVAPLGSTVVAAHQVALNFSSLVFMFPMSIGAAVSIRVGHKLGEQDTKGAAIAANVGLMTGLATACITALLTVLFREQIALLYTENQVVVALAMQLLLFAAIYQCMDAVQVVAAGSLRGYKDMTAIFHRTFISYWVLGLPTGYILGMTNWLTEQPLGAKGFWLGFIIGLSAAALMLGQRLYWLQKQSDDVQLHLAAK

SEQ ID NO: 13800 - protein, 232 aa, Pinus taeda
LTGAHGYGGWESAHATFYGGSDASGTMGGACGYGNLYSQGYGTNTAALSTALFNDGLSCGACYEMRCNDDPQWCLPGTVTVTATNFCPPNNALPNDNGGWCNPPLQHFDMAEPAFLKIAKYRGGIVPILYTRVPCLRKGGIRFTVNGHSYFNLVLITNVGGAGDVHAVSIKGSMSGWQPMSRNWGQNWQSNSYLNGQSLSFQVTTSDGRTIVSNNVAPSNWQFGQTFEGSQV

SEQ ID NO: 13801 - protein, 232 aa, Pinus taeda
LTGAHGYGGWESAHATFYGGSDASGTMGGACGYGNLYSQGYGTNTAALSTALFNDGLSCGACYEMRCNDDPQWCLPGTVTVTATNFCPPNNALPNDNGGWCNPPLQHFDMAEPAFLKIAKYRGGIVPILYTRVPCLRKGGIRFTVNGHSYFNLVLITNVGGAGDVHAVSIKGSRSGWQPMSRNWGQNWQSNSYLNGQSLSFQVTTSDGRTVVSNNVAPSNWQFGQTFEGSQV

SEQ ID NO: 13802 - protein, 232 aa, Pinus taeda
LTGAHGYGGWESAHATFYGGSDASGTMGGACGYGNLYSQGYGTNTAALSTALFNDGLSCGACYEMQCNDDPQWCLPGTVTITATNFCPPNNALPNDNGGWCNPPLQHFDMAEPAFLKIAKYRGGIVPILYTRVPCLRKGGIRFTVNGHSCFNLVLITNVGGAGDVHAVSIKGPRSGWQPMSRNWGQNWQSNSYLNGQSLSFQVTTSDGRTVVSNNVAPSNWQFGQTFEGSQV

SEQ ID NO: 13803 - protein, 232 aa, Pinus taeda
LTGAHGYGGWESAHATFYGGSDASGTMGGACGYGNLYSQGYGTNTAALSTALFNDGLSCGACYEMQCNDDPQWCLPGTVTVTATNFCPPNNALPNDNGGWCNPPLQHFDMAEPAFLKIAKYRGGIVPILYTRVPCLRKGGIRFTVNGHSYFNLVLITNVGGAGDVNAVSIKGSRSGWQPMSRNWGQNWQSNSYLNGQSLSFQVTTSDGRTVVSNNVAPSNWQFGQTFEGSQV

SEQ ID NO: 13804 - protein, 146 aa, Pisum sativum
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 13805 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 13806 - protein, 472 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEMYYRL

SEQ ID NO: 13807 - protein, 357 aa, Solanum tuberosum
SLTVRAASSYADELIKTAKTVASPGRGILAMDESNATCGKRLASIGLENTEANRQAYRTLLVSAPGLGQYISGAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGALNARQGTPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 13808 - protein, 468 aa, Neisseria meningitidis
MSIKNVVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13809 - protein, 468 aa, Neisseria meningitidis
MSIKDAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTKFSTLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13810 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13811 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13812 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALSALKADHEFLLRGGVFSKDWIDSYIAFKEEDVRRIRMAPHPLEFEM

SEQ ID NO: 13813 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13814 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGIEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13815 - protein, 468 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEM

SEQ ID NO: 13816 - protein, 419 aa, Neisseria lactamica
FTVPARIVLEDPEEWFENGQAFDGSSIGGWKGIQASDMQLRPDPATAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13817 - protein, 419 aa, Neisseria polysaccharea
FTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKVAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13818 - protein, 419 aa, Neisseria mucosa
FTIPARIVLDDPEEWFENGQAFDGSSIGGWKGIQASDMQLRPDPATAFIDPFYDDTTVVLTCDVIDPADGQGYDRDPRSIARRAEAYLKSTGIGDTAYFGPEPEFFVFDGVEFETDMHKTRYEITSESGAWASGLHMDGQNTGHRPTVKGGYAPVAPIDAGQDLRSAMVNILEELGIEVEVHHAEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13819 - protein, 419 aa, Neisseria cinerea
FTVPARIVLKDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13820 - protein, 419 aa, Neisseria pharyngis subsp. flava
FTIPTRIVLDDPEEWFENGQAFDGSSIGGWKGIQASDMQLRPDPATAFIDPFFDDTTVVLTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13821 - protein, 419 aa, Neisseria flavescens
FTIPTRIVLDDPEEWFENGQAFDGSSIGGWKGIQASDMQLRPDASTAFVDPFYDDTTVVFTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 13822 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 13823 - protein, 475 aa, Viburnum acerifolium
  misc_feature (131)..(131): Xaa can be any naturally occurring amino acid
  misc_feature (447)..(447): Xaa can be any naturally occurring amino acid
MSPQTETKASAGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALXALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVRSGGIHVWHMPALTEIFGDDSVLQFGGGTLGHPWGNAPGAVANRVALEACVQARNEGRDLAREGNEVIRXASKWSPELAAACEVWKEIKFEFEAMDTL

SEQ ID NO: 13824 - protein, 466 aa, Diervilla sessilifolia
SAGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWSPELAAACEVWKEIKFEFEAMDTL

SEQ ID NO: 13825 - protein, 466 aa, Morina longifolia
SAGFKAGVKDYKLTYYTPDYETKDTDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDETVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWSPELAAACEVWKEIKFEFEAMDTL

SEQ ID NO: 13826 - protein, 470 aa, Pterocephalus hookeri
ETKASAGFKAGVKDYKLTYYTPDYETKDTDMLAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIDKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEAMDTL

SEQ ID NO: 13827 - protein, 475 aa, Dipsacus mitis
  misc_feature (81)..(81): Xaa can be any naturally occurring amino acid
  misc_feature (327)..(329): Xaa can be any naturally occurring amino acid
MSPQTETKASAGFKAGVKDYKLTYYTPDYETKDTDILAAFRVTPQPGVPPEEAGAAVAAESSTGTWTTVWTDGLTSLDRYXGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIXXXTVVGKLEGERLITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEAMDTL

SEQ ID NO: 13828 - protein, 465 aa, Scabiosa columbaria
AGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIDKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13829 - protein, 466 aa, Patrinia triloba
SAGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIRAAAKWSPELAAACEVWKEIKFEFEPVDTV

SEQ ID NO: 13830 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 13831 - protein, 475 aa, Begonia herbacea
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13832 - protein, 475 aa, Begonia oxyloba
MSPQTETKASVGFKAGVKDYKLTYYTPEYKTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMNKRAVFARELAVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 13833 - protein, 475 aa, Coriaria arborea
MSPQTETKASVGFKAGVKDYKLTYYTPEYETKDTDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSSELAAACEVWKEIKFEFEAMDTL

SEQ ID NO: 13834 - protein, 466 aa, Dryas drummondii
SVGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFEAMDTL

SEQ ID NO: 13835 - protein, 475 aa, Hillebrandia sandwicensis
MSPQTETKASVGFKAGVKDYKLTYYTPEYETKDTDILAAFRVSPQPGVPPEEAGAAVAAESSTGTWTTVWTDGLTSLDRYKGRCYYIEPVAGEENQYIAYVAYPLDLFEEGSVANMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCTEAIYKAQAETGEIKGHYLNATAGTCEEMMKRAIFARELGVPIVMHDYITGGFTANTSLAHYCRDNGLLLHIHRAMHAVIDRQKNHGIHFRVLAKALRMSGGDHIHSGTVVGKLEGERDITLGFVDLLRDDYIEKDRTRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 13836 - protein, 475 aa, Marah macrocarpus
MSPQTETKASVGFKAGVKDYKLTYYTPEYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKAIKFEFAAVDTL

SEQ ID NO: 13837 - protein, 466 aa, Neoalsomitra sarcophila
SVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13838 - protein, 466 aa, Retanilla trinervia
SVGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIKFEFEAMDTL

SEQ ID NO: 13839 - protein, 475 aa, Xerosicyos decaryi
MSPQTETKASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWVNAPGAVANRVALEACVQARNEGRDLAREGNEIIREASKWSPELAAACEVWKEIKFEFEAMDTL

SEQ ID NO: 13840 - protein, 496 aa, Chlamydia trachomatis
MFYSLIPVSRFMIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESALLFIQVVYSPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETASGAHPVHAVKTMRSIIQETEKTFDYHAFFQLNDKNSALKVSPYLEANWVFWIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDALSPSLDEIVP

SEQ ID NO: 13841 - protein, 405 aa, Chlamydia trachomatis
MSMDKLSIRDLSLEGKKVLVRVDFNVPIKDGKILDDVRIRSAMPTIHYLLKQDAAVILVSHLGRPKGGVFEEAYSLAPIVPVLEGYLGHHVPLSPDCIGEVARQAVAQLSPGRVLLLENVRFHKGEEHPDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCTSQISHVSTGGGASLEFLEKGSLPGTEILSPAQS

SEQ ID NO: 13842 - protein, 151 aa, Brassica oleracea var. alboglabra
SRASGQGLEELMNEVVVISKLQHRNLVRVLGCCIEGEERLLVYEYMPNKSLDAYLFDPTKQKILDWKTRFNIMEGISRGVLYLHRDSRLRIIHRDLKASNILLDDNLNPKISDFGLARVFEANEDAAETRRVVGTYGYMSPEYAMEGYFSE

SEQ ID NO: 13843 - protein, 150 aa, Brassica oleracea var. alboglabra
SRASGQGLEELMNEVVVISKLQHRNLVRVLGCCIEGEERLLVYEYMPNKSLDAYQFDPTKQKILDWKTRFNIMEGISRGLLYLHRDSRLRIIHIDLKASNILLDDNLIQVSDFGLARVFEENEDAAETRRVVGTYGYMSPEYAMEGYFSE

SEQ ID NO: 13844 - protein, 275 aa, Agrobacterium tumefaciens str. C58
MDKRFADLRAENRPALITYFMGGDPDFQTSLGIMKALPEAGADVIELGMPFSDPMADGPAIQLAGQRALKGGQTLKTTLDLAREFRKQDNATPIVMMGYYNPIYIYGVEKFLDDAIASGIDGLIVVDLPPEMDDELCIPALARGINFIRLATPTTDGKRLPAVLKNTSGFVYYVSMNGITGSALPDPSLISGAVGRIKAHTELPVCVGFGVKTADHAKAIGAVADGVVVGSAIVNQIAGSLTKDGQATADTVPAVTTLVKGLSTGVRASRLAAAE

SEQ ID NO: 13845 - protein, 500 aa, Beta vulgaris subsp. vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 13846 - protein, 268 aa, Agrobacterium tumefaciens str. C58
MACRDMFPDMEPLPCPTFEDAFNAIENGEADLGMIPIENTLAGRVADIHHLLPESRLHIIGEYFMPIRFQLMVVPGVTKDEIRTVHSHIHALGQCRKIIRSNGWKPVIAGDTAGSARLVSEKGDRSMAALAPRLAADLYGLDILAENVEDSENNVTRFVVLSRDENWAKRQSSDEIVVTTFVFNVRNIPAALYKAMGGFATNGINMTKLESYQLGGKFVATQFYADIEGHPDDEPVRHALDELRFFSEKVRILGVYNGHAMRGKLNQS

SEQ ID NO: 13847 - protein, 460 aa, Agrobacterium tumefaciens str. C58
METACWCIMYDIENAKKFFADNPDIEILEAFVIDANGVPRGKWIPRERAIDVLEKGMAIPRSVYALDIWGRDVHAAGLAEGTGDPDGFCFPVPGTLSRVTWLGRPTAQVLLAMKNADGTGFYGDPRHVLSQVLNAYKKAGLTPVVATELEFYLIDPVRSALDPVRPPHSREGRWHTGQTQVLSISELQDFEDVFHDIATACRAQGVLADTTLRENGPGQYEINLNHVPDALQAADFAVFLKRIVKGVARRHELDATFMAKPYGLQAGNGMHVHFSVLDRDGRNIYAGENGPSDALMHSVGGLLENMGESMAIFAPHANSYRRLTPSEHAPTYASWGIDNRSAAVRVIVASKAATRIEHRVAGADTNPYLVLAMILSAAIAGMKEKRQPGGAIAGDSHAINHEPLPTNWDYALQRFTRSSFAYATLGQKYRTLFSACKQQELSEFSLRVTDVEYDAYIRTV

SEQ ID NO: 13848 - protein, 333 aa, Agrobacterium tumefaciens str. C58
MKKRTLGNNLSVSALGLGCMGMTHAYSPTGDENSAIATLHRAVELGVTFFDTAEVYGPYNNEILVGKGLKPYRDKVVIATKFGFRIDPSKPAGQMMVGTDSRPENVRAVAEASLKRLGVDVIDLFYQHRVDPNVPIEDTLGAMAELVQQGKVKYLGLSEASAETLRKAHAVHPIAAIQSEYSLWTRDVEENGVLETCRELGIGFVPFSPLGRGALTGALKSLDGLAADDFRRGLPRFQSENFDANLALIKLLEDMAAEKGVTAGQLALAWVLAQGDFIVPIPGTTKIANLENNVAATDVSLTADEVASLGALLSPAKVAGERYPERMSQMANR

SEQ ID NO: 13849 - protein, 322 aa, Agrobacterium tumefaciens str. C58
MPEARKPGRGRVYSSITETIGDTPIVRLDKLAKEKGVKANLLAKLEFFNPIGSVKDRIGVAMIEALEAQGKITPGKTTLVEPTSGNTGIALAFAAAAKGYKLILTMPETMSVERRKMLALLGAELVLTEGPKGMKGAIAKAQELAETLPDAVIPQQFENPANPDIHRRTTAEEIWNDTDGTVDILVSGIGTGGTITGTGQVLKSRKPEVKVIAVEPADSPVLSGGNPGPHKIQGIGAGFAPAILDTGVYDEIVTVTNDEAFEIARLAARLEGVPVGISSGAALAAAIKVGAREENAGKNIVVIIPSFAERYLSTALFEGLGL

SEQ ID NO: 13850 - protein, 308 aa, Agrobacterium tumefaciens str. C58
MILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 13851 - protein, 399 aa, Agrobacterium tumefaciens str. C58
MAEAAAPLFDTFARAPLRFERGEGVWLFTESGERYLDFAAGVAVNSLGHAHPHLVEAIKTQAEKVWHVSNLYEVPGQEKLAKRLTEATFADKVFFTNSGAEALECAIKTARRYHYSKGHPEKFRIITFEGAFHGRTLATIAAGGQQKYLEGFGPKVEGFDQVPFGDVDALKAAITAETAALLIEPIQGEGGIRAPAKEFLQLLRSLCDEHDLLLIFDEVQTGVGRTGKFFAYEQTGVAPDIMAVAKGIGGGFPLGACLATADAASGMTAGVHGTTYGGNPLAMAVGNAVLDVVLADGFLEKVRDVALVFRQGLASLKDRYPDVIEEIRGEGLLLGIKARVPSGELLQAMRAEHLLGVPAGDNVIRLLPPLVTTAEEAREGLARVEAAAASLTAKQAKIA

SEQ ID NO: 13852 - protein, 394 aa, Agrobacterium tumefaciens str. C58
MSNKWRPATQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLAAVSA

SEQ ID NO: 13853 - protein, 241 aa, Agrobacterium tumefaciens str. C58
MSRKFISEFLGTFWLVFGGCGSAVFAAAFPELGIGFLGVAFAFGLTVLTMAYAVGGISGGHFNPAVSVGLTVAGKFPAANLVPYIVAQVLGAVVAAAALYVILTGKAGAEIGGFAANGYGEHSPGGYSLLSALLIEIILTAFFLVVILGSTHGRVPVGFAPVAIGLALTLIHLISIPVTNTSVNPARSTGQALFVGGWALQQLWLFWLAPILGGAIGAVVWKIFGEEEKAGHAGSVQPAKT

SEQ ID NO: 13854 - protein, 473 aa, Agrobacterium tumefaciens str. C58
MPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 13855 - protein, 342 aa, Agrobacterium tumefaciens str. C58
MTKTMKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDLAA

SEQ ID NO: 13856 - protein, 311 aa, Agrobacterium tumefaciens str. C58
MATRLYEHPIFLEHITPEGHPERPDRLRSLNIALEHPNFERLDRKEAPQANEDAVLLAHPEEHLLAVMRQVPEEDGEINRIESDTYLSPKSLQAALTGIGAAMAAVDDVFSGAADNVFVAARPPGHHAETAKAMGFCLFNNVAIAARHAQKAHGAERIAIIDWDVHHGNGTQDIFWNDISVLFCSTHQMPLYPWSGDKNETGVKNNIVNAPLSPNTGSDHFREAFKSRVLPAIADFSPDLILISAGFDAHHRDPLAQINLVGEDFDWATGRLLEMADKYASNRVVSLLEGGYDLEGLAESAAMHILRMMKG

SEQ ID NO: 13857 - protein, 351 aa, Agrobacterium tumefaciens str. C58
MKGIFMEVKVSGITKQFDRFPALNDVSLDIRSGELIALLGPSGSGKTTLLRLIAGLEQPTQGQIFFGDEDASHRTVQERNVGFVFQHYALFRHMTVADNIAFGLKVRPSASRPPKAEIRRRVSELLDMVHLTGLEKRYPTQLSGGQRQRVALARAVAIEPKVLLLDEPFGALDAKVRKELRRWLREFHDRTGHTTVFVTHDQEEALELADRVVVMSQGKIEQVGTADDVYDTPNSPFVFSFIGESSSLPVTIRDGHVLFQGESIGINEGGTGEGELFFRPEDVVLTDEKDALYGKVTTCRRLAGTRIAEIDIANNGHEPYHLEIEVPLNAAVAVGAELRFRPTRWKVFGKK

SEQ ID NO: 13858 - protein, 327 aa, Agrobacterium tumefaciens str. C58
MRFIDLPSHGGPEVMQSSKAPLPKPARGEILVKVEAAGVNRPDVAQRQGIYPPPKGASPILGLEIAGEVVALGEGVDEFKLGDKVCALANGGGYAEYCAVPAGQALPFPKGYDAVKAAALPETFFTVWANLFQMAGLTEGETVLIHGGTSGIGTTAIQLAKAFGAEVYATAGSAEKCEACVKLGTKRAINYREEDFAEIVKSETGGKGVDVVLDMIGAAYFEKNLAALAKDGCLSIIAFLGGATAEKVDLRPIMVKRLTVTGSTMRPRTADEKRAIRDELVEQVWPLIESGKVAPVINRVFTLEEVVDAHRLMESSNHIGKIVMKVS

SEQ ID NO: 13859 - protein, 493 aa, Agrobacterium tumefaciens str. C58
MTIATPLKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 13860 - protein, 469 aa, Agrobacterium tumefaciens str. C58
MSAVAFMGVRSVMNEVSKPMSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHLRDTREHF

SEQ ID NO: 13861 - protein, 405 aa, Agrobacterium tumefaciens str. C58
MTGRLVIVGAGQAAFALASKLRALKDERPITIIGSEDAYPYQRPPLSKKYLLGEMSFDRLMFRPEEWYAENNVDIRLSTWVEEIDRAAKTVRMQDGSTLSYDKLALATGAAPRLLPASIGGDLEGVLTVRDKRDADRLVEEMKPGRRLLVIGGGYIGLEAAAVARKLGLEVTLIEMADRILQRVAAKETADIMRGIHQAHGVSIREKTGLVRLVGMDGRVAAAELSDGSMLDVDFVIVGIGVTPNDRLARESGLDVGNGIVVDALTRTSDADIHAVGDCNMLPWRGQHVRLESVQNAVDQAEAAAEVLAGTEAAYEAKPWFWSDQYEVKLQIAGFNLGYDETMLRPGAREGSWSVWYFRDGRFVAVDAVNDAKAYVAGKKLLDIGAEPDRAILADAAADLKLLLS

SEQ ID NO: 13862 - protein, 468 aa, Agrobacterium tumefaciens str. C58
MAKAKTQFVCQNCGTVHNRWAGKCEGCGEWNTIVEEDPMGGIGSGPGKVPKKGRPVTLTSLSGEIEEAPRIPTGISELDRATGGGFVRGSAVLIGGDPGIGKSTLLMQAAAALSRRGHRVIYVSGEEAVAQVRLRAQRLGSADTDVLLAAETNVEDILATVSEGKRPDLIIIDSIQTLWSDTADSAPGTVTQVRTGVQAMIRFAKQTGATMVLVGHVTKEGQIAGPRVVEHMVDAVLYFEGDRGHHYRILRTVKNRFGPTDEIGVFEMSDGGLREVSNPSELFLGERNEKSPGAAVFAGIEGTRPVLVEVQALVAATSLGTPRRAVVGWDSSRLAMILAVLEAHCGVKLGQHDVYLNVAGGYRISEPAADMAIASALVSSLAGLALPADCVYFGEISLSGAVRPVAHTVQRLKEAEKLGFSAALLPSGSAELPKAGKGRWTEIESLPDLVAHIAGSGNRFKQVEDDEY

SEQ ID NO: 13863 - protein, 345 aa, Agrobacterium tumefaciens str. C58
MTIHSSALSAIGNTPLIRLKAASEATGCEILGKAEFLNPGQSVKDRAALYIIRDAERRGQLRPGGTIVEGTAGNTGIGLSLVANALGYKTVIVIPETQSQEKKDALKLLGAKLVEVPAAPYSNPNNYVKVSGRLAKQLAATDENGAIWANQFDNIANRQAHIETTAPEIWDQTDGKVDGFICSVGSGGTLAGVADGLRDFNPDIKIGLADPEGAALYEFYKHGVLKSEGSSITEGIGQGRITANLEGFAPDFSYRISDAEALPVLFDLVTKEGLCLGGSSGINIAGAIRLARELGPGHTIVTILCDYGNRYQSKLFNPDFLRSKGLPVPQWLATKSEIPVPYETV

SEQ ID NO: 13864 - protein, 317 aa, Agrobacterium tumefaciens str. C58
MPAKTIDHAFTATTLTSAATDPTHAGVLSFMRRKYTKNLKGVSTAIWGIPFDAATSNRPGARFGPQAIRRASAIFDNDPQYPFARDLFAHMPTIDYGDCLLDYGNHWKTPDTIEKEARRIISKTDYLLTLGGDHFITWPLLKAHVAKHGRLALVQFDAHQDTWFDDGKRIDHGSFVARAVRDGLIDPDRSIQIGIRTHAPDDFGIRILHGYEVEDMRASDIASLIVKHTGGMPAYLTFDIDCLDPAFAPGTGTPVAGGPTSAKILSVLRGLGQLDIRGSDVVEVAPAYDHADITAIAGATVAMYMLGLRAERLAKAG

SEQ ID NO: 13865 - protein, 393 aa, Agrobacterium tumefaciens str. C58
MGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGAHADNPIDFQEFMILPVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRSILRG

SEQ ID NO: 13866 - protein, 481 aa, Agrobacterium tumefaciens str. C58
MAQSYDVIIIGSGPGGYIAAIRAAQLGMKVAVVEREHLAGICSNWGCIPTKALLRTADVMHTATHAKDYGLTLEGSIKPDVKAIVARSRGIAARMNNGVGFLFKKNKVDIIWGEAKITKPGEIVVGKSTKPVVQPQGPVPKNTLGEGTYTAKHIIVATGARPRALPGIEPDGKLIWTYFEAMKPEELPKSLLVMGSGAIGIEFASFYRTMGVDVTVVEIMSQVMPVEDAEISAFAKKQLEKQGIKIHLETKVSKVEKAANSVTATLEKKDGSSEKIIADRMISAVGVVANVEGIGLEAAGVKTDRGFIIIDGYGKTNVPGIYAIGDVAGPPLLAHKAEHEAVICVEKIAGLPNVHPMDKLKIPGCTYCNPQVASVGLTEAKAKEQGRDIRVGRFSFAANGKAVALGEDQGMVKTIFDKKTGELLGAHMVGAEVTELIQGFVVAMNLETTEEDLMHTIFPHPTISESMKESVLDAYGRVLNA

SEQ ID NO: 13867 - protein, 476 aa, Agrobacterium tumefaciens str. C58
MEQAEIGLIGLGVMGSNLALNIAEKGNKIAVFNRTPEVTRKFYADAGELQGQIIPCETIEEFVAAIRPPRPIIIMIKAGDPVDQQMEILKPHLANGDIMIDAGNANFRDTIRRFDNLKDSGLTFIGMGVSGGEEGARHGPSIMVGGTEDSWKRVEKVLTSISAKYNDDPCVAWLGNDGAGHFVKTIHNGIEYADMQMIAEIYGILRDGLKMSAVEIADVFAEWNKGRLNSYLIEITEKVLRAADPITGKPMVDLILDKAGQKGTGKWSVIEAQNMGVAATAIEAAVAARILSSQKDEREAAEKIFGLPTLAAAPADKKAFIADLESALLAAKVGAYAQGFAIMSAASKEFNWNLPMPTIARIWRAGCIIRSEFLDEITSAFTKDPHVANLIVTPAFSAIVKDTDAPLRRVVSYAVLSGLPVSALASALGYFDAYRRGRGSANLIQAQRDFFGAHGFERTDGVDKPHGPWGSGADIF

SEQ ID NO: 13868 - protein, 355 aa, Agrobacterium tumefaciens str. C58
MFTTSAYACDDGSSPMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSLPRQKAA

SEQ ID NO: 13869 - protein, 281 aa, Agrobacterium tumefaciens str. C58
MEPTENLDVCLATLRDTDRDRYLACLLSPADKRNALAALYAFNAEIARIRDSVREALPGEVRMQWWRDLVDGNPHGDSQSHPVAAALLTTIEHYRLPRPVLGNMIEARIFDLYDDLFEDRNALEGYAGETASALIQLASLVLSAEDAAHSAEAAGHAGVAQAMAGMLLLMPLHRRRGQVYIPADMLAAAGLDRETFLAGQDRQRIGIAVEIFAAHALDHIEKARRATISKNLFAAYLPVALSGPVIAAARKAGAGVFDGDLQLSQLRRQWLLAKASFLKRF

SEQ ID NO: 13870 - protein, 257 aa, Agrobacterium tumefaciens str. C58
MAENQAKKLAVSTTDVAIEITGMNKWYGDFHVLRDINLKVMKGERIVIAGPSGSGKSTMIRCINRLEEHQSGSIQVDGIELTNDLKKIDEVRREVGMVFQHFNLFPHLTILENCTLAPIWVRKMPKKEAEEVAMHYLKRVKIPEQAHKYPGQLSGGQQQRVAIARSLCMKPKIMLFDEPTSALDPEMVKEVLDTMVSLAEDGMTMLCVTHEMGFARQVANRVIFMDQGQIVEQNSPAEFFDNPQHERTRLFLSQILH

SEQ ID NO: 13871 - protein, 406 aa, Agrobacterium tumefaciens str. C58
MEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 13872 - protein, 342 aa, Agrobacterium tumefaciens str. C58
MRALQLVDDRKLEKVDLPEPDAPGPGEVTLRVKAVALNHIDVWGWRGMAFAKRKMPLTIGAEASGVVEAIGPGVSNVLPGQLVSVYGARTCGLCKPCREGRDNLCEHVQGVHGFHLDGFAQEKINIPARQLVPAPHGIDAVAAALAPVTFGTVEHMLFDNAKLEPGETILIHAGGSGIGTAAIQLAKKMGCTVITTVGSDDKIERAKALGADHVINYRTDRFEGVVRKLTKKKGVDVVFEHVGKDTFVASMFSLKRGGRLVTCGSTSGVSTEINLMMLFQQQLKLLGSFGCRMENMANAMQKMARGIVHPVIDTEVTFDDIDRALERMETRQVFGKIVLRMD

SEQ ID NO: 13873 - protein, 464 aa, Agrobacterium tumefaciens str. C58
MTMTAYDYDLFVIGGGSGGVRSGRVAASLGKRVGIAEEYRYGGTCVIRGCVPKKLFVYASQFPEYFEDAEGFGWSVGERRFDWKKLIAAKDKEITRLEGLYRKGLENAKADIFDSRAELVDAHTVKLTKTGETYTAERIVIAVGGTPNEHKALPGHELTISSNEAFDLEEPPKSILIAGGGYIAVEFANIFHGLGVETTLIYRGKEILSRFDHDMRKGLHEAMEAKGIRIILEDIIEEVSKDGAGGFVARTKQGSSLHVGLVMLALGRDPNTKGLGLENAGVKVDARGAIIVDDYSRTNVPSIFALGDVTDRVQLTPVAIHEAMCFIETEYKNNPTKPDHELIATAVFSQPEIGTVGLSEEEAGKKYRELEVYRAQFRPMKATLSGRQEKTIMKLIVNASDRRVVGVHILGHEAGEMAQLLGITLKAGCTKDDFDRTMAVHPTAAEELVTMYAPSYRVVNGERV

SEQ ID NO: 13874 - protein, 256 aa, Agrobacterium tumefaciens str. C58
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 13875 - protein, 278 aa, Agrobacterium tumefaciens str. C58
METQDQKPQETKTAKNGREAVLSVEGVTVGFNGRNVLEDLNLDVYRGEILGFIGPSGAGKSVLMRAILRLLPRQAGAIRILGTDYDKASEDDRMMLDQRLGVLFQQGALFSGLTVKENIQLPMREYLDLPKKLMDELAYLKIEMVGLKPDAGDKYPSELSGGMIKRAALARALSLDPDLVFLDEPTSGLDPIGAAEFDMLIARLRDSLGLTVYMVTHDLDSLFSVCDRIAVLGDKRVLVEGTLQDMFACDDPWVQSYFRGKRARSVVLPDGKHENPVE

SEQ ID NO: 13876 - protein, 494 aa, Agrobacterium tumefaciens str. C58
MASRPFRDDATPDATSGIEIYSVPGFFMYQFDLIVVGSGPAGRRAAIQAAKLEKKVLVIEKGSRVGGVSVHTGTIPSKTLRETALNLTGWRERGFYGRAYRVKQEIDADDLRRRLLITLDHEVEVLEHQFARNRVQHIRGTASFIDANTMKVVKSDGEVMTVTATSILLTIGTRPYRPPHIPFDGQAVLDSDEILEIKELPRSMVVVGAGVIGIEYATIFSALDTQVTVVEPRETMLEFIDKEIVEDFTYQLRDRNMKLIFGQKAEKVERDESGKCLVSLSNGRVLKAETVLFAAGRVGATDTLNLSACGLEADSRGRLKVDPETFQTSVPNIYAAGDIIGFPSLASTSMEQGRIAARHAVGAPAGEPPQFFPYGIYAVPEISTCGLTEEEVVERGIPYECGIAHFRETSRGHIMGLDSGLLKMIFSLKTRRLLGVHIVGEGATELVHIGQAVLNLKGTVEYFVENTFNYPTLAEAYKIAGLDAWNRMGELKKD

SEQ ID NO: 13877 - protein, 375 aa, Agrobacterium tumefaciens str. C58
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAGAGQEISTRPFQLVTGRNWMGTAFGGARGRTDVPKIVDWYMEGKIQIDPMITHTMPLEDINKGFELMHKGESIRGVVVY

SEQ ID NO: 13878 - protein, 510 aa, Agrobacterium tumefaciens str. C58
MTPHFLLHHLLAARAASEDQALVHKEQSLTYREFAEAAAHCAAALHEAGTERGDRVVIYLPRGFEECWSIFGVSMASGVFVPVNALLKAQQIRHIVTDCGAKIVISSMAMMDELKAALTDLPDITILLAEEITARKSAPARPSAAIGEDLAAILYTSGSTGSPKGVMLSHRNLLAGARIVRTYLDITGKDRILSLLPFSFDYGLNQLLTAVEQGATTIISTFRLGDEIVRDLRDQAITGLAGVPTIWAILTRAAPLLAKTPLPHLRYLTNSGGRVPQETVKALREKLPDTKIYLMYGLTEAFRSTFLPPDEIDRRPTSIGKAIPECEIFIVTDKGQRAKPGEPGILVHRGPTVSLGYWNRPEDTAKVLRPHPFIPAARGGETVCYSGDLAVEDEDGFFSFVARNDAMIKSSGYRISPTEVEESLMSTGLFREVAVIGLPDPFAGEKVHAVATAASETIDVSAALKKAAEMLAPFMIPRAIELVERLPITANGKVDYRALVRERTDNGAHG

SEQ ID NO: 13879 - protein, 189 aa, Agrobacterium tumefaciens str. C58
MKLVRFAFAGALFAGALAASTFASAAELLTVQLKDGPVVIELMPQVAPKHVAQIEALAKKGAYDNVAFHRVIDGFMAQTGDVQYGNMEKGFNAQRAGTGGSDMADIPAEFSKTPFTRGVVGMARSSDPNSANSQFFIMFADGPFLNGQYTVVGKVVSGMEAVDKIKRGAGGNGEVSNPDRMIKVTVGKK

SEQ ID NO: 13880 - protein, 150 aa, Agrobacterium tumefaciens str. C58
MSIPFPSAPADKEALENAGLFSPKFDAHGLVTAVVTDARDGELLMVAHMNAEALSLTLETGIAHYYSRSRDKIWKKGETSGNLQTVKEFRTDCDQDAVWLKVSVAGHDATCHTGRRSCFYRTVELSNGDAVTKITDDTRHFDPATTYSNT

SEQ ID NO: 13881 - protein, 491 aa, Agrobacterium tumefaciens str. C58
MIFLSQLSLFDPAAMARIDAAAGQSGISLYDLMERAGHAVAASGLRHYPQALRFVVLCGGGNNGGDGYVAARALVQSGATVTVHHLGDAGTLRGDARVAFERSGLVPLPLGDYTPLAGDVVIDAVFGAGLSRDVPQELARIIEAVTSARVPVLAVDLPSGLCGRRGVPLGASFRAERTVTFMARKPGHLLMPGRELCGALEVFDIGIPLRILADHAGSVAENHPLVWRDALPASDLETHKFRRGHLTVFSGPAHATGASRMTALAALKAGAGIVTIAAPKEALDLLSVTLTAVMNAPMDNADDLRLWLDDQRHGTFVLGPGFGDLKKARQFVSLLGDKAAVLDADAITAFKDHAAALFERITSGAGKFVLTPHEGEFARLFPDLAADRTLSKIEKAQVASARSGAALVYKGADTVIAAPDGRALVSTNAPASLATAGSGDVLAGIIGALLAQGTPAFEAAAAGVWLHGEAGHRAGDGMTAEDLAHAVRPFG

SEQ ID NO: 13882 - protein, 225 aa, Agrobacterium tumefaciens str. C58
MSLPIRIAPSILAANFAKLGQEVADVTEAGADWIHLDVMDGHFVPNISFGPDVIKALRPHSMAFFDCHLMIEPVDPYLEAFAKAGCDSITVHAEAGPHLHRSLQTIRGLGRKAGVTLNPATPLSVIENVLDDVDLILIMSVNPGFGGQKFIPAMLDKIRAAKAMIGDRPIDLEVDGGVTAETAGAIIAAGANALVAGSAVFKGDGVADYRKTVAQLRMAAEAGRT

SEQ ID NO: 13883 - protein, 309 aa, Agrobacterium tumefaciens str. C58
MQDIQGIVDSIYDSMLPRLGEGKVADYIPELAKVDPNQFGIAITTVDGTTYTAGNALVPFSIQSISKVFMLTLALGKAGETVWNRVGREPSGSSFNSIVQLEHEHGIPRNPFVNAGAIVVTDIVLSGHQPREAIGELLRFVRYLADDDTISIDDTVAKSEQATGFRNFALANFMRSFGNLHHPVEHTLGVYFHQCALSMTCAQLSRAGLFLANRGRNPLSGHTVVSDRRARRINALMLTCGHYDGSGDFAYHVGLPGKSGVGGGIMAVAPGNASIAVWSPGLNKVGNSALGSQALELLATKTGWSVFGA

SEQ ID NO: 13884 - protein, 196 aa, Agrobacterium tumefaciens str. C58 [sequence omitted]

SEQ ID NO: 13885 - protein, 348 aa, Agrobacterium tumefaciens str. C58
MAIARGYAATDASKPLTPFTFERREPNDDDVVIDIKYAGICHSDIHTVRNEWHNAVYPIVPGHEIAGVVRAVGSKVTRFKVGDHVGVGCFVDSCVGCATRDVDNEQYMPGLVQTYNSVERDGKSATQGGYSDHIVVREDYVLSIPDNLPLDASAPLLCAGITLYSPLQHWNAGPGKKVAIVGMGGLGHMGVKIGSAMGADITVLSQTLSKKEDGLKLGAKEYYATSDASTFEKLAGTFDLILCTVSAEIDWNAYLNLLKVNGTMVLLGVPEHAIPVHAFSVIPARRSLAGSMIGSIKETQEMLDFCGKHDIVSEIETIGIKDVNEAYERVLKSDVRYRFVIDMASLDA

SEQ ID NO: 13886 - protein, 504 aa, Agrobacterium tumefaciens str. C58
MDSSSSGVSYKKADASYFEKRGLSRYAGVWSLWALGVGAVISGHFSGWNFGFSTGGWGGMLVAGIIIAIMYLGLTFSIAEMSPALPHTGAAYSFARTAMGPWGGFVTGLCENVEYVLTPAVVVTFITAYVNSILGLDPAYSPFVWIVFYAIFLALNVFGLELSFKVTLVITLISLAVLVFFWISAIPNIDFSRFALNIGVGPDGKAVELPEGGGSFFPFGFSGVLATLPFAVWLFLAIEQLPLAAEESVDPKRDMPKGIILGMVTLMVSAFMIVLLNPSLPGVGAFHLSSSLEPLLDGFKAIYGDGGVVLLGLVALTGLIASFHTILYAQGRQIYSLSRAGYFPTVLSITHSKYRTPYVANITGAIVGLAVMLVIWFSLGAEQGGSIIGSVLLNMAVFGAMFSYIMQAISFILLRKNLPNIERPFRSPFGIPGALLTIIIAIVTLLYQIQDPNFTKGVLWVAVWFAVAIAYFAFVGRHRLILSPEEEFALEHKQAAVAAAAAKA

SEQ ID NO: 13887 - protein, 465 aa, Agrobacterium tumefaciens str. C58
MSSSVVAETVPSGSGSWFSHFKATLVLGIPLIGAQLAQLGIHTTDMVIVGQLGAEKLAAMVLAGQFFFVVFIFGSGFSVAVVPMVAQAYGQGDATSARRSLRMGMWVAIAYWLLALPIFFNAERILVYLGQNPNVAALTGHYLAIAKFGLLPALLFYVLRGLVSAIGRAGIILYVTIIMLVMNGLMAYVLVFGHFGLPAMGMNGAAVVAVIVNAFSFIFIVAYVQTREETKKYELFVRFWRPDWHALFEVLRLGLPISITILAEVTLFAAASILMGQIGTVQLAAHGIALQLASIAFMIPLGLSQAATVRVGVARGQGDFKNLIRASIMIYAIACGIALCGGILFAAVPEFLAKWFLDPKLPEAAEVLAYASSLVVIAGIFQLVDGIQAVTAGLLRGLKDARIPAMLALISYWPIGLALAWTMAFPLGFGGRGVWFGFVIGLSTAAVLLTVRFVLLVKREMKTAR

SEQ ID NO: 13888 - protein, 370 aa, Agrobacterium tumefaciens str. C58
MTSLFEPAQAGDIALANRIVMAPLTRNRSPGAIPNNLNATYYEQRATAGLIVTEGTPISQQGQGYADVPGLYKQEAIEGWKKITDGVHSAGGKIVAQIWHVGRISHTSLQPHGGQPVAPSAIPAKSKTYIINDDGTGAFAETSEPRALTIDDIGLILEDYRSGARAALEAGFDGVEIHAANGYLIEQFLKSSTNQRTDDYGGSIENRARFLLEVVDAVAEEIGAGRTGIRLSPVTPANDIFEADPQPLYNYVVEELGKRNLAFIHVVEGATGGPRDFKQGDKPFDYATFKGAYRNAGGKGLWIANNGYDRESAIEAVESGKVDAVAFGKAFIANPDLVRRLKDNAPLNEPNQPTFYGGGAEGYTDYPALG

SEQ ID NO: 13889 - protein, 505 aa, Agrobacterium tumefaciens str. C58
MNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 13890 - protein, 437 aa, Agrobacterium tumefaciens str. C58
MTAITMNDALERAGAGAYQRRLMGIFGLVWAADAMQVLAVGFTAASIAATFGLTVPQALQTGTAFFFGMLLGAAGFGRLADRYGRRRVLIVTVACDALFGVLSIFSPDFTILLVLRFLTGAAVGGTLPVDYAMMAEFLPAKNRGRWLVFLEGFWAVGTLIVALAAWGASLAGVADAWRYIFAVTAFPAVLGLGLRFLVPESPLYLLRTGRSEEAKAVVNRMLVVNGRAPLDAGTGLFQPDVTKGQGIFSPALRQRSMMILAIWFLVSVSYYGVFTWMPAKLAGDGFGFVRGYGFLVLVALAQIPGYAIAAYGVEKWGRKPTLIGFCLLSALGCLLFTLASAGAMIAASLLIMSFALLGTWGALYAFTPELYPTESRATGMGAAGAMARLGGLLAPSLLGYAIAQGFGVAIGIFAGLLVLAAIAATMINAETRQVALT

SEQ ID NO: 13891 - protein, 352 aa, Agrobacterium tumefaciens str. C58
MAPVNIQNVQKRFGSVNVIHGIDIDIKDGEFVVLVGPSGCGKSTLLRMIAGLEELSDGEIHIGPREVSHLPARDRDIAMVFQNYALYPHMTVKDNMGFALKLKKVSADETKAKVDRAAAILGLEKLLDRYPRQLSGGQRQRVAMGRALVRDPQVFLFDEPLSNLDAKLRVQMRGEIKAMHQRIGTTTIYVTHDQVEAMTMADKIVVLHDGIIEQIGAPLELYDNPANLFVAGFIGSPAMNFIRGRVEEGVFRTIKGLSLPLPAHADIGKLGGRDLVYGVRPEHIRAAESGIEGRVELVEGTGSEIYTKLNCKGDEIACLFRERLNVRFGDTIHIAIDPATVHLFDKDSGKRI

SEQ ID NO: 13892 - protein, 449 aa, Agrobacterium tumefaciens str. C58
MQGRGDADPYRMARSCVKGRNMSTNYLSAASVRTKNPAGVIATCGLMIMFDGYDLVVYGAVAPALLKESTWALNPAMVGRAAALTLVGMLLGALFAGTMADRIGRRKVVLLSLAGFSAMMIASAMTPNFLAFEITRFFAGLGLGALLPTVTALVLEFSPPQRRAQANSLSFLGYLIGGIISGILGMLLLESYGWRPLMLIGGLPLILLPIFMRFLPESPEWLASKGRQAEADGICDSYGLQRIVPHAKMQKGGVGALFSEGRLASTLNAWGIHFCSLLLTFGMVNWLPTIMNKMGYDISSALSFSVMLNVGAAIGILIGGRFADKGNVKVVVAILFAVGAASIFALTANKGPLLYVFVALAGAGTIGTQILANVLVGRLYPVHIRGTGLGFSLAVGRLGGIAGPMIGGLVLQRGLAPEWNFYIFGSVAVVGLMLTVLTLLYRTSGDARV

SEQ ID NO: 13893 - protein, 468 aa, Agrobacterium tumefaciens str. C58
MAYDVVVIGTGPGGYVCAVKAAQLGLKVAVIEKRATYGGTCLNVGCIPSKALLHASETFAHVAHGVDTLGIEVAAPKLNLEKMMGHKDGVVKANVDGVAFLFKKNKIDAFQGTGKVVSAGKVSVTNDKGETQEIEAKNIVIATGSDVAGIPGVKVDIDETVIVSSTGAIALSKVPEKLIVVGGGVIGLELGSVWSRLGAKVTVVEYLDNILGGMDGEVSKQSQRLLAKQGLDFKLGAKVTAVEKTAAGAKVVFEPVKGGAAETLEADVVLISTGRKPYTEGLGLAEAGVVLDSRGRVEIDGHYKTNVDGIYAIGDVVKGPMLAHKAEDEGVALAEILAGQRGHVNYDVIPAVVYTQPEIASVGNTEEELKAAGVAYKVGKFPFTANGRARAMQVTDGFVKILADKETDRVLGGHIVGFGAGEMIHEITVLMEFGGSSEDLGRTCHAHPTMSEAVKEAALATFFKPIHM

SEQ ID NO: 13894 - protein, 300 aa, Agrobacterium tumefaciens str. C58
MSVGGEEKKRSVAFIGTGLMGGPMARRLLGTGFSVKVWNRSVDKAQALVADGAVLAASPAEAARGADIVITMLSDGNAVGEVLFEAGVAEALAKGAVVIDSSSIAPPIAREHSSRLQAMGIHHVDAPVSGGVPGATAGTLAIMAGGDEALISGLVDVFAPMGRLTYVGPSGAGQLCKLANQQIVAITIGAVAEAMMLVEAGGASREGFRNAIRGGFAESRILELHGERMVKRNFVPGGPSKFQLKDLNGVLATAKDLALTLPLTQQVTREFDDFVGDGGADIDHSGILLYLEKLNNREQG

SEQ ID NO: 13895 - protein, 170 aa, Agrobacterium tumefaciens str. C58
MTIKAEDLPYRPCAGIMVLNAQGLVWAGRRIKEGNSEYDGSPQLWQMPQGGIDDGERPLTAAIRELYEETGMKTVTLLAEASDWIHYDLPPELIGIGLRGKYRGQAQRWFAFRFEGDESEIQIDPPPTGHSAEFDAWDWKPMESLPELIVPFKRAVYEKVVAEFQHLSGK

SEQ ID NO: 13896 - protein, 1329 aa, Agrobacterium tumefaciens str. C58
MEPTVFAPIAPSLPVREDEPYARDEMLHEIFEQTAKRFQAKCAVRLLGHDPENSRRTRLSYAQLAERATRFARQLRAMGVQRGDRVVICLPRGLDQYMAILGTLWAGACYVPVDWSYPQDRIDFIAEDSGATLIVTDAERAGGMRVTTLVVNETLGDLAAQDAVPITRAESGASPDDLAYIIYTSGTTGRPKGVMISHRSACHFLRSEGAILAIEESDRVFGGFSIAFDMSIETMWSAFSAGAELLVATEALHKAGPDVGITLAAESVTVWHVVPSLFTLVEAEIPTLRIVNLGGEACPPDLVERWARPGLRILNTYGPTETTVTATWTEVQPGRRVTIGRPLPGYTAWIVDEKLWPVAAGAEGELVIGGPGLSGGYVNRPDLTADKFVNTPFYGPDGLPARIYRSGDLVRLDAVGDIEFMGRIDTQVKIRGFRVELAEIEAVIAEDASVAQAVVHLFRDNDGSELLAAFLVARGNAAIDMEAARKRVNDRLPNYMRPVVYQVLDALPTLPASGKVDRKALQRPVVVAVTDRETVAPETPLEIQLHAIWSEAFAPQKVSVEDDLFEDLGGHSLKAARLASAIRKSSGLSGVSIQDLYAAPTIRRLAERLRDRVTADTAVLEPFHRVSEFQKRLCWALQTIALVPIYAVAGLQWFFPYLAYTYLVEDFGRVSALLLGGLSFVFIPPLGMVFAIIVKWLIIGRYKPGDYPLWGSYYLRWWLVRRLSDIIATPYLSGTPMIRFYYRLLGARIGRRAFIGTVSIDTADLVTIGDDAIVSDYAMLATSSVERGLLRIGSVRIGNSAFIGTMSVVGRNSAIGDAAALDDLSSLPMNQSIPSGESWSGSPAKCIATGRIAQRDGEAGFLRRLLVGFGLFIAAVILPLVAILPIAPGLIAMIEIDWNTDGYSYLLISPFLALTYIILMCVLTVAAKRLILGPVRPGRYSIHSWFYLRFWFVQQVTDLALALLHPIYATLYVIPWYRALGVRIGKRAEISTAAKIVPDLVDIGPESFIADAVVFGAARHEPGIIELAHTRIGRRSFIGNSAVLPTGATIADGVLIGVLSKPPADGGAEQPDGTWFGSPPISLPVRQAVGLFDEGARFNPRPRLVAMRLAIEAIRVILPLTLFLAFFSLLFSVVGDIQDYDDSHLLIAVIFPFLYIGFALACGLSVVALKWLVMGRYKPTTKPLWSTFVWRTELVTATYENLAVPNLLQPLRGTPWLAFFLRLLGCKIGRDCFIDTTDITEHDLVRIGDEVALNEFSGLQTHLFEDRVMKVSGVTVGDRAVIGSYAIVLYDAEIGEDAQLGDLSVVMKGETLPAGTSWEGSPAQLVRNA

SEQ ID NO: 13897 - protein, 315 aa, Agrobacterium tumefaciens str. C58
MALKMENMQDIRDIAVIGTGIMGAPMAARLAEAGFAVRAWNRRAEKAAILAEKGVRQAATTIDAAVEADVVICMLSSGPVCDEVLLGPSGVVSAMKPGSVLLVMSSIPVDSAREQAQAARAHGVRYVDAPVSGGEKGAIEGTLAIMAGGEQRDVDALRPLLNCLGRVTHVGPVGCGSLAKLANQLIVASTICAVAEALTLVEAGGADPAQVRQALLGGFAESTVFRQHGKRMVEGDFRPGGPAKYQVKDTSTALAFAKSRGLSLPVGEEVDRLFRSMVEHGAGELDHSGVILEIKRMNAFGGTLETVQSISSKSA

SEQ ID NO: 13898 - protein, 335 aa, Agrobacterium tumefaciens str. C58
MLMEETMRQASVLAPHTNGPTVTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAELDAFMAAQLSEEVL

SEQ ID NO: 13899 - protein, 357 aa, Agrobacterium tumefaciens str. C58
MASVELRDIRKSYAALDVIHGISLDIADGEFIALVGPSGCGKSTLLRMIAGLEEITDGDILIGDKVVNSMTPRERNIAMVFQSYALYPHMTVAENMGFNLKLAGQPKNVIEERVAEAARMLDLGKLLDRKPSQLSGGQRQRVAMGRAVVRNPAVFLFDEPLSNLDAKLRVQMRSEIKALHQKVGTTSIYVTHDQIEAMTLADRVVVLNHGRIEQQGTPLELYKTPANLFVAAFIGSPAMNLIEGVVDGEGDQPAARLKDGTAIRIAASRKVKRGQPVTIGLRPEHIGSSIGGDIALSGRTVLVEPTGAQTHVVFELAGDQVTAVVDGEQPVKVNTPFAATVHHERVHVFDRASGLAL

SEQ ID NO: 13900 - protein, 450 aa, Agrobacterium tumefaciens str. C58
MTILPNSVEARDIAYQMHPNVNLRKFEKTGGLVIESGEGIYVTDSSGKRYIEAMAGLWSVALGFGEQRLVDAATKQMQKLPYYHTFSYKTHGPSVDLAELLIELSPVPMSKVHFTSSGSEANDLVAKMVWYRSNALGKKDKKKIIGRIKGYHGVTIASASITGLPRNHESFDLPLDRMLHTACPSYVHFGKDGESEAEFTARILGELEELILREGPETVAAFWGEPVMGAGGVLLPPEGYWEGVQAILKKYDILLVVDEVICGFGRTGKMFACETYDIKPDVLVVSKQISSSYMPLSAIIMNDSFYQPIADESDRIGSFGHGYTASGHPVATAVGLENLKIIQERDLVGNVARLEGKFLDHLKALADHPLIHSSRGIGLLGALEVKPWDGTKPGDTTLALAAAIESEGVITRPIGESICFCPPLIITAEQLDELFAGVKRGLDNALAARG

SEQ ID NO: 13901 - protein, 444 aa, Agrobacterium tumefaciens str. C58
MDNPSRSNSTSLDSYWMPFTANRQFKANPRLLTSAEGMYYTSNDGRQVLDGTAGLWCVNAGHGRQQIASAVKHQLSTLDYAPSFQMGHPVAFEFAERLAEIAPGPEGGKLDRVFYTGSGSESVDTALKIAIAYQRAIGQGTRSRLIGRERGYHGVGFGGISVGGLVNNRRVFPQIPADHLRHTHDLARNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGAVFTSRKVHDALMHGPENQIELFHGYTYSGHPVACAAGIATLDIYRDEGLFTRAAELQDAWHDAIHSLKSAANVIDIRTIGFIAGIELQSREGAVGARAYDVFVDCFERGLLIRVTGDIIALSPPLIAEKSHFDDIVSILGDALNRAV

SEQ ID NO: 13902 - protein, 476 aa, Agrobacterium tumefaciens str. C58
MNEQSRKITPVLLAGGAGSRLWPVSRDQLPKQFQPLVGNLSTYQQTLKRVGDKSLYSEPLVITNEDFRFFARRQAEEIDLPATVVLEPARRDSAAAMAAAAVLAERREPGCLVLALAADHVVLDVDKFSEAVKLGAKAADQGNIVVFGLVPTEPRTSYGYIKPGDAIDGEKDLSTVDAFVEKPDVTTAISYLEKGYLWNSGNFLFRSDVMIAELKAFAPEILAAVTQAVEQYESDLGFVRLHQASFEASPKNSIDYAVIEKTKRMAVVHGHFRWSDIGSWDAIWEIADKHDNDNALEGDGVFIDSEGCLIHSTQLLTTVVGAKDLVVVATKDAVLVVPKNRVQDVKGLVDTLKGGDHAPQTQTHKRVYRPWGYIEHMYVDQRYRVGHITVDPGHRISFQKHYHRSEHWIVVKGTATVTIGEETRLLTENQSVYIPIGQPHRLANEGQIPLELVEIQTGAYLGEDDVIRIEDDYKRQ

SEQ ID NO: 13903 - protein, 248 aa, Agrobacterium tumefaciens str. C58
MHLSFGDNQVLKGIDLTVNKGDAVSIIGPSGSGKSTILRCINGLLIPQSGKITVGGTRVDQLKTEAERIALRKRIGIVFQQFNLFPHLTVMENITIAPIKILGTPKAEAERHARELLEKVRLSQKVDAYPGQLSGGQQQRVAIARALAMRPELVLFDEVTSALDPETVGEVLAVIRDLVNDGMTSILVTHEMRFAEEISDKIVFTENGLIVDQGTPEHIFYRSTNPRINAFVKGLGGQVARVTDGEGI

SEQ ID NO: 13904 - protein, 487 aa, Agrobacterium tumefaciens str. C58
MTLSFDPDSLTLPIGHFIGGRLIPAQNGIDMHRPSDGVEYAGCPRANAALVDEAVQTAKAALKSSNWGGVRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGL

SEQ ID NO: 13905 - protein, 486 aa, Agrobacterium tumefaciens str. C58
MMQGLKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETKTFHIGGLA

SEQ ID NO: 13906 - protein, 457 aa, Agrobacterium tumefaciens str. C58
MLSNSLIELDRAHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQTLEDPAVRAAMA

SEQ ID NO: 13907 - protein, 505 aa, Agrobacterium tumefaciens str. C58
MRTPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSLIDL

SEQ ID NO: 13908 - protein, 478 aa, Agrobacterium tumefaciens str. C58
MHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 13909 - protein, 341 aa, Agrobacterium tumefaciens str. C58
MKIRLENVVKTFDTFRAVRDVSLDIESGELLALLGPSGSGKTTILRMVAGLEYSDGGRIFFGDEDATNIPVRDRGVGFVFQHYALFPHMTLHENIAFGMKVSKVKRDKAAIDARVKELLNLVKLDGLGDRFPAQISGGQRQRVALARALSVDPKVLLLDEPFGALDANVRRDLRRWLREIHDSLGITTIFVTHDQEEALDLADRVVILNQGGIVQQGTPKEVCRQPNSSFVMRFLGDANRVSGVARGGKVYVGENELPFSYTQGDGAVDIYARPGDLEWEDLHEGIPASVERVLDRAGERRVIASTDGGDILEFDVPPENDVTAGDRGSVIIRRAKIFPVA

SEQ ID NO: 13910 - protein, 510 aa, Agrobacterium tumefaciens str. C58
MPGILEQLETRRQEARLGGGVKRIEAQHAKGKLTARERIDVLLDEGSFEEYDMYVTHRAVDFGMAEQKVAGDGVVTGWGTINGRQVYVFSQDFTVLGGSLSETHAQKICKIMDMAVRNGAPVIGLNDSGGARIQEGVASLGGYADVFKRNVVASGVVPQISVIMGPCAGGAVYSPAMTDFIFMVRDTSYMFVTGPDVVKTVTNEIVTAEELGGASTHTKKSSVADGAYENDIETLEHVRLLFDFLPLNNREKPPVRPFHDDPARLEARLDTLIPDSSNKPYDMKELIHALADEGDFFELQEAFARNIITGFIRLEGQTVGVVANQPMVLAGCLDIDSSRKAARFVRFCDAFNIPLLTLVDVPGFLPGTAQEYGGVIKHGAKLLFAYSEATVPMVTLITRKAYGGAYDVMASKHIGADVNYAWPTAEIAVMGAKGAAEILYRSELADPEKIAARTKEYEERFANPFVAAERGFIDEVIMPHSSRRRIARAFASLRNKSVETRWKKHDTIPL

SEQ ID NO: 13911 - protein, 180 aa, Agrobacterium tumefaciens str. C58
MPVVRGKNIEPLYTAEQIAERNRDMAKHIAGGPTKDLLVIAVLKGSFIFAADLIRALHDSGLAPEVEFITLSSYGAGTVSQGVRIVKDIDSDVKDRDVLLIDDILESGRTLRFAKELLYERGARNVTIAVLLDKKVKRKEDLEADYVGFECPDYFVVGYGMDVAYAFRELPFVGVVTGDA

SEQ ID NO: 13912 - protein, 491 aa, Agrobacterium tumefaciens str. C58
MNIHNNSGTATHPATDPVTAIVTGFNLKTPGSKRAAAYNRDFLSDKSSIGLPFTMQTKEALYPIVATHAEGAYLQDVDNNRYVDILMGLGTNLFGHNPSFIRTAIEAQLTKGFALGPQSDLAGETAELFCCITGKDRVTFSNTGTEAVQTAMRIARAATGRDKIVLFTGSYHGHSDPALHKATKLEYIRRGALLRSHPAWLVALKPLLKRMVLTKAVPGFSGVAPSSARDIVLLEYGNPRSIDYIRRHGDSLAGVLVEPVQSRNPELQPREFLHELRSVTEKTGSALIFDEMITGFRVAPGGAQSHFGIDADIATYGKIAGGGLPLSLIAGKGRFMDFVDGGAWAYGDSSFPKVAPTFFAGTYCRHPLALAAAKAVATRLLEDGPTLQEGLNARTQAFVERLNGALKGAGLPVAFMSFGSFFAISAARSRISPQAVTMLSFLLLTSGVHLRAGDRGGFLSTAHSDDDIAFVHDAVLQSLTALADHRLLDRH

SEQ ID NO: 13913 - protein, 400 aa, Agrobacterium tumefaciens str. C58
MPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 13914 - protein, 341 aa, Agrobacterium tumefaciens str. C58
MTERLEDIAIKMVADGKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWKQELEKAA

SEQ ID NO: 13915 - protein, 479 aa, Agrobacterium tumefaciens str. C58
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRIAYIGSDGQSGV

SEQ ID NO: 13916 - protein, 484 aa, Agrobacterium tumefaciens str. C58
MGKVTGFLEIDRQVGKYQPASDRIRHFREFTIPMSDAEVQKQAARCMDCGIPYCHGPTGCPVHNQIPDWNDLVYNNNWEEAIRNLHSTNNFPEFTGRVCPAPCEEACTLNLEDAPVAIKTVEQAIADKAYELGFIVPKPATIHTGKKVAIIGSGPSGMAAAQQLGRAGHEVHVYERESKAGGLLRYGIPDFKMEKNFIDRRVEQIKGEGVTFHCGVNVGVDVTVEALLADHDAVLYCGGSETPRPAGIGGADFNGVYDAMPYLVQQNRRVGRENIDSVGWPADPILAGGKHVVVVGGGDTASDCVGTAFRQGAVKVTQLDIRPMPPEKEDKLAVWPFWATKMRTSSSQAEGAIREFQVATLEFVGEDGVLTGVKCCQVDDRRKPIAGTEFIIKADLAFIAIGFSGPFTDSVLKEMEGKLTLNTDRRGSTNVVANETDYRTSVDKLWTAGDVRRGQSLVVWAIREGRQAARAIDEALMGATVLPR

SEQ ID NO: 13917 - protein, 485 aa, Agrobacterium tumefaciens str. C58
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 13918 - protein, 485 aa, Agrobacterium tumefaciens str. C58
MTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 13919 - protein, 361 aa, Agrobacterium tumefaciens str. C58
MILSDSNEVLVDCQNVWKIFGARASTAVKAVARGGLSKKQVLEDFDCVVGVCDASLQVHRGEIFCIMGLSGSGKSTLIRLLNRLIEPSLGKITVKGKDIARLNAAELRELRARNIAMVFQSVALLPYRTVLENAGFSLEVRGVAKDERNRIARAALEKVGLADWTSRYPHELSGGMQQRVGLARALAADPEIILMDEPFSALDPLIRRQLQDEFRQLTKSLGKSAVFITHDLEEAIRIGDRIAIMKDGVIVQVGTAEEIVTKPADDYVSDFVAGISRIHLVKAHTVMQPVAEFAASQPQCDIGTLLRASPRDDIGALIDLTMQSDHDAVAVVEKDLVIGIVTTRDLLRGVAGTAEEESVAA

SEQ ID NO: 13920 - protein, 505 aa, Agrobacterium tumefaciens str. C58
MHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 13921 - protein, 306 aa, Agrobacterium tumefaciens str. C58
MDIRLVGAPLQIGAGQLGCEMGPSAYRVAGLAHALEELGHRVVDTGNVMPAPLREFCHPNPAVHHLAETVAWTEALTEAAYRESADAVPIFLGGDHAISAGTVAGMARRVAETGRPFFVLWLDAHTDYHTLETTRSGNLHGTPVAYFSGRDGFSGYFPPLSHAVAEENIGMIGIRSVDPAERAALEKSGITVHDMRSIDEHGVAVILREFLARVQAANGLLHVSLDVDFLEPSIAPAVGTTVPGGATFREAHLVMEMLHDSGLVCSLDLVELNPFLDERGRTATLMVDLATSLMGKRVMDRPTRAG

SEQ ID NO: 13922 - protein, 313 aa, Agrobacterium tumefaciens str. C58
MRPDDTTTLWEEAVNSMTEKNKVALIGAGAMGGAIGTRLVETGNHLTVFDLDAEKVAALTSLGAESARTAAEAAAVSDVVILSLNSPKIVRIAVFGKDGVAAGAKAGTLIIDMSSIDPEATKELAADAAEKGLRWVDSPLSGGAPKALIGQLTLMAGGSEKDVADAHRVLQHVASNYTHMGPCGAGQTTKLINQVLCGLNFLAVAEATQLALDAGVDAAKIPQALKGGRADSAILQEYMPRYVAKDYRRTGRIDNMVKDLNGAQDLARRTNTAMPLTAVCAEVHRMLTAAGLGGEDQAALMEFFSGAKRTFPD

SEQ ID NO: 13923 - protein, 304 aa, Agrobacterium tumefaciens str. C58
MRIIAERNAPMKTVAFLGLGHMGLPMAANLVKAGYAVRGFDLSEACRTAAREAGIPVAADATEATHAADVVITMLPKGEHVVSVYGDLVRKVSAGTLLIDCSTVDMESALKAHELAASAGCPSVDAPVSGGTSGAAAGTLTFMCGGEPDAFSAARPVLEAMGKKIVHCGKGGNGQAAKICNNMILGISMIAVSEAFVLGEKLGLSHQALFDVASTSSGQCWSLTTYCPVPGPVPTSPANKDYQPGFAAALMLKDLKLSQAAANGTGVSTPLGAAASALYESFVGEGGGGRDFSAIVEMLRGGEA

SEQ ID NO: 13924 - protein, 1228 aa, Agrobacterium tumefaciens str. C58
MADGASNAGVTIQQVGNSIFQNFAPPVREQSLLRKAVTAAYRRAEEECMAPLIEAATVTADQAKAIRDTARKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGEQFVTGETIGEAIKRSKPLEEQGFQYSYDMLGEAATTAKDAERYYKDYENAIHAIGKASAGRGIYGGPGISIKLSALHPRYARAQAERVMAELLPRVKSLMLLSKTYDIGLNIDAEEADRLELSLDLLEELALDKDLAGWNGLGFVVQAYGRRCPFVLDYIIDLARRSGRRIMVRLVKGAYWDAEIKRAQVEGLEDFPVFTRKVHTDVSYIACARKLLDARDLVFPQFATHNAQSMATIYHLAGPDFKLGDYEFQCLHGMGEPLYSEVVGKKKLDRPCRFYAPVGTHETLLAYLVRRLLENGANSSFVNRIADPAVPVDSLLEDPVAVVKAYAVPGAQHDRIAAPADLFGPERKNSAGVDLSNETTLSALDKTLKAGAATEWKAAAPQAGGQTRPVLNPGDHSDIVGHVTEPTEADVEAAMQRAAASSWPSMPVEDRAACLERAADAMQAEMPTLLGLIMREAGKSMPNAIAEVREAIDFLRYYAAEARRNFKSDEKSLGPVVCISPWNFPLAIFIGQVAAALVAGNPVLAKPAEETPLIAAQGVRLLHEAGVPQDAVQLLPGDGKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKIAALPGPLVLFQAATTDALSGESQPYTLDWLVEEVSVSVNTTAAGGNASLMSIG

SEQ ID NO: 13925 - protein, 370 aa, Agrobacterium tumefaciens str. C58
MAKITLNNVTKNWGETQVLKPMNLTIENGEFVAILGPSGCGKSTTLFLLAGLYAPTGGEIAFDGQNVNRIDARDRNVGVVFQSYALYPNLTVRENIAFPLRFKSMGKEEVARRMDEAAALVQISSLLDRRPSQLSGGQQQRVALARALVKEPNILLLDEPLSNLDATLRITMRAELKSIQKRLGFTTLIVTHDQIEAITMADRIICMNNGEIAQIGTPDDLYRRPNNLFVAGFIGTPPMNRMKGHAKGGRLEIAEASFDLTSDHTGEVTFGLRPEDITLVSLERAALKGEVASVEPMGREVFYTIVTPAGPVHALEYGESVRYAPGAQVGIACKPDFTLVFDKEGDRIIGLHADLSHDAEARARTLQPAN

SEQ ID NO: 13926 - protein, 493 aa, Agrobacterium tumefaciens str. C58
MRSKVMRRFQCYIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVAAIVPWNSQLFLAAVKIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLRTSDDPIPDPFVMR

SEQ ID NO: 13927 - protein, 360 aa, Agrobacterium tumefaciens str. C58
MTKPLLQIRGIRKQYGPLVAVQDVNLDVQPGEFMTFLGPSGSGKSTTLYILAGFEQPTSGDILLNGESLLSTPSHKRNIGMVFQRYTLFPHLSVGENIAFPLKVRRRSKADIDAKVKEMLRLVRLEGFEDRKPAQMSGGQQQRVALARALAYDPPVLLMDEPLSALDKKLREEIQFEIRRIHQQTEVTILYVTHDQEEALRLSDRIAVFSKGVIDQIGTGPELYAHPTTRFVAEFIGDSDFIACDLIAASGGKATVSLGRDIIFDHIPMHGEAAPGKKAALMLRPERLQLSRNRPVASAGFQATVSDITFLGNNVHVVAHTGSGEPLAVRLPFGHEAISGLNRGDLVHLAFDPASAQVFC

SEQ ID NO: 13928 - protein, 484 aa, Agrobacterium tumefaciens str. C58
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAEEARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCIGNIL

SEQ ID NO: 13929 - protein, 312 aa, Agrobacterium tumefaciens str. C58
MPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEF

SEQ ID NO: 13930 - protein, 395 aa, Agrobacterium tumefaciens str. C58
MSERAAFHWQDPFLLEDQLTDDERMIRDSAEAFGKSELLPRISEAYLSETTEPELFRLMGRTGLLGVTLPEEYGAANASYVAYGLVAREVERIDSGYRSMMSVQSSLVIHPIFAYGSDEQKKKYLPGLVSGELIGCFGLTEPDAGSDPGGMKTRAEKIEGGYRLRGSKMWISNAPIADVFVVWAKSEAHDNEIRGFVLEKGMKGLSAPKIGGKLSLRASITGEIVMDGVEVGEDALLPNVSGLKGPFGCLNRARYGISWGVMGAAEDCWFRSRQYGLDRKQFGKPLAGTQLYQKKLADMQTEIALGLQASLRVGRLMDEHKMAPEMISIVKRNNCGKALDIARQARDMHGGNGIQIEYHVMRHAQNLETVNTYEGTHDVHALILGRAQTGIQAFF

SEQ ID NO: 13931 - protein, 459 aa, Agrobacterium tumefaciens str. C58
MTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 13932 - protein, 235 aa, Agrobacterium tumefaciens str. C58
MDKTIKSAEEALSSIGDGATIMIGGFGGSGAPIELIHALIDKGPKNLTVINNNAGNGRIGIAAMIDAGMVKKMICSFPRSSDPRAFTDRYLAGEIELELVPQGTLAERIRAGGAGIPAFYTPTGFGTELANGKVIAEFDGRSYVQERWLKADFAIVKAELGDTYGNLTYNKAGRNFNPLMCMAAKTTIAQVSRIVAAGEIDPEHVVTPGIFVNGVVEIPDPQQEEVLIRAGVAYA

SEQ ID NO: 13933 - protein, 346 aa, Agrobacterium tumefaciens str. C58
MSELEISNISKDYGASRALHPVSITVERGEFVTILGPSGCGKSTLLRILTGISQPSGGEIRLGGKRIDQAQPEARDIAMVFQSYALFPHMSVAKNLGFGLKMKKVAKDERARRIAHALEICNLTGLVDRMPRQLSGGQQQRVALARAIVMQPSLLLFDEPLSNLDAKLRDTLRHELTELHRRIGATSLYVTHDQAEAMAMSDRIVVMNAGRVVEIGTPLELYRAPKHAFTAGFLGQTNLLPVSAEGQQAQLPWGQSVTLDQAAAGNVQISARPENIHICADQAGDGTVSAVSFMGANALYTVEIGGRQIRVSQSGAETLIDAGQRVALQFPGSVHLLDDSVAGEAA

SEQ ID NO: 13934 - protein, 207 aa, Agrobacterium tumefaciens str. C58
MKTLASLSAFVGKTFAIWVILFAVLGFFFPETFRQIAPWIVTLLSIIMFGMGLTLSVDDFREVVKRPFDVTIGVLGQFLIMPLLAVLLTRIIPMPPEVAAGVILVGCCPGGTSSNVMTYLSKGDVALSVACTSVTTLAAPLVTPFLVWLFASQFLPVDGWAMFLSIVKVVLLPLALGAALQKLVPGIVKAAVPALPLVSVIGIVLIV

SEQ ID NO: 13935 - protein, 483 aa, Agrobacterium tumefaciens str. C58
MQTVNLFIGGDHCAAANGKRFERNNPITGDAVTSAAAASVEDATNAADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 13936 - protein, 467 aa, Agrobacterium tumefaciens str. C58
MTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLKAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 13937 - protein, 492 aa, Agrobacterium tumefaciens str. C58
MKGIASAALKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 13938 - protein, 353 aa, Agrobacterium tumefaciens str. C58
MITVKPGSVVFENVRKTFGAFTAIPDLSLTIEPGTLVTLLGPSGCGKTTTLRMLAGLEHPNSGRILIGGKDVTMLPANERDVSMVFQSYALFPHMSALDNVAYGLQSSGLKKAEAREKAEEGLKLVGLAGMGHRLPAELSGGQQQRVAVARALVLEPQVLLLDEPLSNLDARLRRRVRTDIRELQQRIGFTAVYVTHDQDEALAVSDRIIVMKEGEIAQSGAPRELYEAPASSFIADFMGEANVVPCEVVSQTGDESLVRVGTMEHRVRSRGPRSGSAKLAVRPGAITIGAAGGSGMPGRVLHTAYLGGHIEYEVETEVGTLFIIDHEMNHTQRETSDVTLNFKNRGIALIDA

SEQ ID NO: 13939 - protein, 467 aa, Agrobacterium tumefaciens str. C58
MQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 13940 - protein, 334 aa, Agrobacterium tumefaciens str. C58
MQIGMVGLGRMGANMVRRLLKQGHDCVVFDVNPDNVAPLVKEGATGATSPDDLVAKLSPPRAVWLMLPAAITPKIARDFAARLQAGDAIIDGGNSNYRDAIDLAAEFAPRGIDFIDTGTSGGIWGLERGYSLMIGGPVAAVQRLDPIFASLAPGAGLGIAADPVTGTAPMGYLHCGPSGAGHFVKMVHNGIEYGVMAAYAEGLNILKAANAGTQHREADAETAPLAHPQYYQFDIDLPAVTEVWRHGSVIGSWLLDLTAQALKQDPNLDQYGGRVSDSGEGRWTLQAAVETGVPAPVLASALFERFSSRGEAEFAGKVLSAMRNAFGGHLEKAK

SEQ ID NO: 13941 - protein, 319 aa, Agrobacterium tumefaciens str. C58
MKAAVYDQAGPPDVLTYRDVADPIVGPDDVLIAVEAISIEGGDLINRRSTPPPGRPWIVGYAASGRVVGAGANVRDRKVGDRVTAFDMQGSHAELWAVPAIRTWLLPSGVDAASAAALPISFGTAHHCLFARGGLLRNQTVLVQAAAGGVGLAAVQLAAQAGATVIAVSSGESRLQRISSLGADHVVDRSMGNVVEAVRQNTGGKGVDLVIDPVGVTLSASLTLLAPEGRLVFVGNAGGGSLTIDLWPAMQSNQTLLGVFMGPLLERPQVRATVDEMLQMLDRREIRVMIEKTFPLSEAAAAHDFAENAKPLGRVIMEP

SEQ ID NO: 13942 - protein, 444 aa, Agrobacterium tumefaciens str. C58
MLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 13943 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 13944 - protein, 328 aa, Agrobacterium tumefaciens str. C58
MKAMSLKSFGGPEAFDLVEVPKPLPKAGQVLVRVHATSINPLDYQVRRGDYRDLVPLPAITGHDVSGVVEATGPGVTMFAPGDEVWYTPQIFDGPGSYAEYHVANENIIGRKPSSLTHLEAASLSLVGGTAWEALVSRAALRVGESILIHGGAGGVGHVAIQVAKAIGAKVYTTVREENFEFARSVGADVVIDYRKEDYVAAIMRETEGLGVDVVFDTLGGETLSHSPKVLAQFGRVVSIVDIARPQNLIEAWGRNASYHFVFTRQNQGKLNELNVLVERGQLRPHVGAVYSLADLPLAHALLEKPNNGLRGKIAIAIDPQAETKVQS

SEQ ID NO: 13945 - protein, 372 aa, Agrobacterium tumefaciens str. C58
MTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 13946 - protein, 484 aa, Agrobacterium tumefaciens str. C58
MTTFSASNWIDGTFVSSSKRGRSIDPATYETIGDYPDDGGAAAQSAIEAAKRAFRGTAWRDDAELRARVLDQMASAIERNRERLIDILSLENGKLLGEAALEIDGSPSKLRYWAAMARTEAGRAKSPKPGSLSVILRQPMGVAGIIVPWNSPVILSVRSFAPALAAGCTVVVKMPGQTAQVGSVITEVLAEATDLPEGVVNMFVESGADGAALLVESPDVPTISFTGSTQTGRTIGAIGAKRMKRFGLELGGKTPMIVFDDADLEAMLPVLEKALTIFAGQFCMTGSRLLVHSSIYELVRDRLAERLRAVKVGPASDPASDMGPLIDKENVARVDSVVKDALSKGATVVVRGGPVPEGPLAKGAFFRPSMLEVFDNSLPIVQQETFGPVITIQRFSDEREAVVLANDNDYGLSASVWTRDLDRSLRVAQALEAGSVFVNDWAKVYDGTEEGGFKQSGLGRLNGVAAIEDFIEYKQVALKPGLLR

SEQ ID NO: 13947 - protein, 335 aa, Agrobacterium tumefaciens str. C58
MTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVFLPHGA

SEQ ID NO: 13948 - protein, 445 aa, Agrobacterium tumefaciens str. C58
MSATTKEILDLNRFDASRTEGFPAELAERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLDIILQARRAA

SEQ ID NO: 13949 - protein, 301 aa, Agrobacterium tumefaciens str. C58
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 13950 - protein, 334 aa, Agrobacterium tumefaciens str. C58
MKAFVVDKYKKKGPLRLADMPNPVIGANDVLVRIHATAINLLDSKVRDGEFKLFLPYRPPFILGHDLAGTVIRVGANVRQFKTGDEVFARPRDHRVGTFAEMIAVDAADLALKPTSLSMEQAASIPLVGLTAWQALIEVGKVKSGQKVFIQAGSGGVGTFAIQLAKHLGATVATTTSAANAELVKSLGADVVIDYKTQDFEQVLSGYDLVLNSQDAKTLEKSLNVLRPGGKLISISGPPDVAFARSLKLNPLLRFVVRMLSRGVLKKASRRGVDYSFLFMRAEGQQLHEIAELIDAGTIRPVVDKVFQFAQTPDALAYVETGRARGKVVVTYAS

SEQ ID NO: 13951 - protein, 465 aa, Dicentra eximia
  misc_feature (407)..(408): Xaa can be any naturally occurring amino acid
  misc_feature (423)..(423): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLSHYCRDNGLLLHIHRAMHAVIDRQKNHGIHFRVLAKTLRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGXXANRVALEACVQARNXGRDLAREGNEIIREASKWSPELAAACEVWKEIKFEFEAMDTL

SEQ ID NO: 13952 - protein, 473 aa, Holboellia latifolia
  misc_feature (81)..(81): Xaa can be any naturally occurring amino acid
  misc_feature (129)..(131): Xaa can be any naturally occurring amino acid
PQTETKASVGFKAGVKDYKLTYYTPDYITKDTDILAAFRVTPQPGVPPEEAGAAVAAESSTGTWTTVWTDGLTSLDRYKGXCYHIEPVAGEENQYICYVAYPLDLFEEGSVTNMFTSIVGNVFGFKALXXXRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 13953 - protein, 474 aa, Lardizabala biternata
SPQTETKASVGFKAGVKDYKLTYYTPDYITKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13954 - protein, 474 aa, Stauntonia hexaphylla
  misc_feature (82)..(82): Xaa can be any naturally occurring amino acid
SPQTETKASVGFKAGVKDYKLTYYTPDYITKDTDILAAFRVTPQPGVPPEEAGAAVAAESSTGTWTTVWTDGLTSLDRYKGXCYHIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 13955 - protein, 176 aa, Rhizobium etli
PIENTIAGRVADIHHLLPDSRLHIIGEYFMPIRFQLMVLPGVTKDEIRTVHSHIHALGQCRKIVRAHGWKPVIAGDTAGAAKLVKETGDRSMAALAPRLAADLYGLEIVAENVEDTENNVTRFVILSRDEEWAQRTSAEEKVVTTFVFNVRNIPAALYKALGGFATNNINMTKLES

SEQ ID NO: 13956 - protein, 183 aa, Rhizobium etli
EVQKQAARCMDCGIPYCHGPTGCPVHNQIPDWNDLVYNNNWEAAIQNLHSTNNFPEFTGRVCPAPCQEACTLNLEDAPVAIKTVEQAIADKAYELGFIRPQPATVHTGKKVAVIGSGPAGMAAAQQLGRAGHEVHVYERETKPGGLLRYGIPDFKMEKNFIDRRVEQMKGEGVTFHCGVNVGV

SEQ ID NO: 13957 - protein, 283 aa, Petunia x hybrida
MSKEVIEEGQVQQHGKDYVDPPPAPLLDFAELKLWSFYRALIAEFIATLLFLYVTVATVIGHKKLNGADKCDGVGILGIAWAFGGMIFVLVYCTAGISGGHINPAVTFGLFLARKVSLTRAIAYIISQSLGAICGVGLVKAFMKSYYNSLGGGANSVNSGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYILRAAAIKALGSFRSNPTN

SEQ ID NO: 13958 - protein, 256 aa, Petunia x hybrida
MAELKKWSFYRAVIAEFIATLLFLYVTIATVIGHKRLNGANPCDGVGILGIAWAFGGMIFVLVYCTAGISGGHINPAVTFGLFLARKVSLIRAVAYIISQCLGAICGVGLVKAFMNKHYYNSLGGGANEVASGYNKGTALGAEIIGTFVLVYTVFSATDPKRSARDSHVPVLAPLPIGFAVFMVHLATIPITGTGINPARSFGAAVIYNQDKAWDDQWIFWVGPFIGALIAALYHQFVLRAGAVKALGSFRSNPTN

SEQ ID NO: 13959 - protein, 286 aa, Petunia x hybrida
MAKNVGSEGSFTTKDYQDPPPAPLIDPAELTQWSFYRALIAEFIATLLFLYITVLTVIGYKSESDPAKNADPCSGVGILGIAWAFGGMIFILVYCTAGISGGHINPAVTFGLFLARKVSLIRAVMYMVAQCLGAICGVGLVKAFQSAYYHRYDGGANMLSDGYSKSVGLSAEIIGTFVLVYTVFSATDPKRNARDSHVPVLAPLPIGFAVFMVHLATIPITGTGINPARSLGAAVIFNQDKAWKDHWIFWVGPFIGAAIAAFYHQFILRAGAAKALGSFRSSTSQA

SEQ ID NO: 13960 - protein, 250 aa, Petunia x hybrida
MPINQISLGSHEELRHSGALKAALAEFISTLIFVFAGQGSGMAYNKLTADGAASPAGLISASLAHAFGLFVAVSVGANISGGHVNPAVTFGAFIGGNITFFRGILYIIAQLLGSTAACFILEFTTGMSTGSFALSDGVGVWNALVFEIVMTFGLVYTVYATAVDPKKGDLGVIAPIAIGFIVGANILAGGAFTGASMNPAVSFGPSLVSWTWTHQWIYWAGPIIGGGLAGVVYELLFINHSHEPLPSGDF

SEQ ID NO: 13961 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 13962 - protein, 349 aa, Gibberella fujikuroi
DPCSVTEYSGLATAVSSCKNIVLNGFQVPTGKQLDLSSLQNDSTVTFKGTTTFATTADNDFNPIVISGSNITITGASGHVIDGNGQAYWDGKGSNSNSNQKPDHFIVVQKTTGNSKITNLNIQNWPVHCFDITGSSQLTISGLILDNRAGDKPNAKSGSLPAAHNTDGFDISSSDHVTLDNNHVYNQDDCVAVTSGTNIVVSNMYCSGGHGLSIGSVGGKSDNVVDGVQFLSSQVVNSQNGCRIKSNSGATGTINNVTYQNIALTNISTYGVDVQQDYLNGGPTGKPTNGVKISNIKFIKVTGTVASSAQDWFILCGDGSCSGFTFSGNAITGGGKTSSCNYPTNTCPS

SEQ ID NO: 13963 - protein, 329 aa, Cryphonectria parasitica
  misc_feature (1)..(1): Xaa can be any naturally occurring amino acid
  misc_feature (54)..(54): Xaa can be any naturally occurring amino acid
XTGSATTTPIDSLDDAYITPVQIGTPAQTLNLDFDTGSSDLWVFSSETTASEVXQTIYTPSKSTTAKLLSGATWSISYGDGSSSSGDVYTDTVSVGGLTVTGQAVESAKKVSSSFTEDSTIDGLLGLAFSTLNTVSPTQQKTFFDNAKASLDSPVFTADLGYHAPGTYNFGFIDTTAYTGSITYTAVSTKQGFWEWTSTGYAVGSGTFKSTSIDGIADTGTTLLYLPATVVSAYWAQVSGAKSSSSVGGYVFPCSATLPSFTFGVGSARIVIPGDYIDFGPISTGSSSCFGGIQSSAGIGINIFGDVALKAAFVVFNGATTPTLGFASK

SEQ ID NO: 13964 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPHGNGQRACIGQQFALHEATLVLGMMLKHFDFEDHTNYELDIKETLTLKPEGFVVKAKSKKIPL

SEQ ID NO: 13965 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPLGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 13966 - protein, 430 aa, Clostridium perfringens
MNNFFKLKEHETNIRTELLAGLTSFFAAVYIIVVNASILSDGGVSMEPLIIATVLASLIGCVLVALLSNAPLIIMPGMGINALFTYTIVNTMGLTFQQALAAVIVAGILFIVVAVTPLADMLTSSIPTSLKEAITVGIGIFITFLGLQKAGLIVGDASTLVKLGDISSKEVIVFFITMILMLVLFIKDVPGSFLIGILSGTIISMLFGIVDLSNFQFSLPNFSEYKQVFLSANFSGITSISFWIATFSLTLVLVFENIGLLHGQIDGMLKQPSKRQRAFNAVAFTTIICGICGTSPSVSTVESSAGIAAGGKTGLTSIFTGFLFLISIFFIPVISLIPNSAIAPVLIIIGGLMIQNIVSINFEDFTESFPAFLTLTIIPLTFSIVDGIAFGFIAYPICKLATKKYKDVSIPMYVISAIFLVYFVLHATQI

SEQ ID NO: 13967 - protein, 414 aa, Sinapis alba
MAFRPIGYTISSLRKASAANDLRFSFLSIYSSFPAKKNLLLSFLRGFSSLHRRQQQQSRVNKSETLAQKIGKSIRRAGAPSKARVYADVNVIKPKDYWDYESLAVQWGAQDDYEVVRKVGRGKYSEVFEGIHATDNEKCVIKILKPVKKKKIKREIKILQNLCGGPNIVKLLDIVRDQQSKTPSLIFEHVNNKDFKVLYPTLSDYDVRYYIYELLKALDFCHSRGIMHRDVKPHNVMIDHEQRKLRLIDWGLAEFYHPGKEYNVRVASRYFKGPELLVDLMDYDYSLDLWSLGCMFAGMIFRKEPFFYGHDNYDQLVKIAKVLGTDELNTYLNRYRIELDPNLASLVGRHSRKPWSKFINSENQHLAVPEAVDFVDKLLKYDHQERPTAKEAMAHPYFNPIRNAESSRSTPRAQ

SEQ ID NO: 13968 - protein, 333 aa, Beta vulgaris
MSKSRVYADVNVLRPREYWDYEALTVQWGDQDDYEVVRKIGRGKYSEVFEGLNVNSNERCVIKILKPVKKKKIKREIKILQNLCGGPNVIKLLDIVRDQHSKTPSLVFEFVNSTDFKVLYPTLSDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSRFVNPDNQHLVSPEAIDFLDKLLRYDHQDRLTAKEAMAHPYFSQVRAAESSRMRTQ

SEQ ID NO: 13969 - protein, 362 aa, Lolium perenne
MTIAEVVAAGDTAAAVVQPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDETNPRKQPYKMSNQKLQDLGLEFRPVSQSLYETVKSLQEKGHLPVLSEQAEADKETLAAELQAGVTIRA

SEQ ID NO: 13970 - protein, 324 aa, Pinus taeda
MTAGKQTEEGQTVCVTGAGGFIASWLVKLLLERGYTVRGTVRNPEDQKNAHLKQLEGAEERLTLVKADLMDYNSLLNAINGCQGVFHVASPVTDDPEEMVEPAVNGTKNVLDACAVAGVRRVVFTSSIGAVYMDPSRDYDALVDENCWSNLDYCKETKNWYCYGKTVAEKAAWERAKDKGLDLVVVNPCVVLGPVLQSSINSSIIHILKYLTGSAKTYANSVQAYVHVRDVAEAHILVYESPSASGRYLCAESVLHRGDVVDSLASMFPQYPIPTKVKEDGKPRVKPWKVSNQKLKDLGLEFTPAKQCLYETVISLQEKGHISK

SEQ ID NO: 13971 - protein, 512 aa, Pinus taeda
MSVPEMGPFGVVVTGIVAIAIVYKLVQRWRFKLPPGPRPWPVVGNLLQIEPVRFRCFWDWSKKYGPIMSVWFGSTLNVVVSNTELAKEVLKEHDQQLADRPRSRSAEKFSRNGQDLIWADYGPHYVKVRKVCTLELFSPKRLEALRPIREDEVAAMVESIFNDCGKQEGIGKPLVVKRYLSGVAFNNITRPAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 13972 - protein, 418 aa, Colletotrichum lagenarium
MGDLQGRKVFKVFNQDFIVDERYTVTKELGQGAYGIVCAAVNNQTQEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPQLFAQANPDALDLLDRMLAFDPSSRISVEQALEHPYLHIWHDASDEPDCPTTFNFDFEVVEDVGDMRKMILEEVYRFRQLVRTVPGSTQAGAQAAGQAGAGQVPIPSGNPGWTSSDPRPQEYVGQGGGLEADLAGGLDHRR

SEQ ID NO: 13973 - protein, 333 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYSSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQVAIFEQGELKAIHWSADAVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 13974 - protein, 509 aa, Sesamum indicum
MALPLLILSFLTIFIAYKLFQRLRYKLPPGPRPLPVVGNLYDIKPLLVRCFTEWSQVYGPIFSVYLGSHLSVVVNSAELAKEVLKDNDQQLANRNRTRQIAKFSKNGADLIWSDYGPHYVKVRKLCTLELFSMKRLEGLRPIREDEVTAMVESIFKDCNKPENKGKALVLREYLGMMAFLHIARLTFGKRFMDSNGVVDGQGEELKAILHNGIKLGTKKSWAEFLPWFRFLFKTENQLLAEHDALADSFTKKIMQEHTLARQKTGNTKNHFVDALLTLQKEYDLSDDTVIGLLWDMISAGMVTTTITVEWAMAELVRNPRVQQKVQEELDRVVGSDRVMTEADIPNLPYLQCVTKECFRMHPPTPLMLPHKASTNVKIGGYDIPKGATVSVNVWALARDPAVWKNPLEFRPERFQEEDIDMKGTDYRLLPFGSGRRICPGAQLAIYLVTSMLGHMLHHFTWTPPAGTKPEDMDMMEQPGTVTYMRTPLQAVPTPRLPADLFKRVASGNV

SEQ ID NO: 13975 - protein, 220 aa, Gossypium hirsutum
KEIEDELENIYHNNNDAENDLYTTSLRFRLLREHGFNVSCDVFNKFKDEQGNFKSSVTSDVRGLLELYQASYLRVHGEDILDEAISFTTNRLSLAVASLDYPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTY

SEQ ID NO: 13976 - protein, 160 aa, Triticum aestivum
MEHGQATIRVDEYGNPVAGHGVGTGMGAHGGSGTGAATGGHFQPTREEHKAGGILQRSGSSSSSSSEDDGMGGRRKKGIKDKIKEKLPGGHGDQQHADGTYGQQGTGMAGTGAHGSAATGGTYGQPGHTGMTGTGTHVTDGAGEKKGIMDKIKEKLPGQH

SEQ ID NO: 13977 - protein, 496 aa, Brucella melitensis 16M
MSKHISFAEAAALIPDNAVVSVSSSSGLGCPDMMLKAIGERFDETGHPQNITTLHPIAAGDMSGIRGVDYIAKKGLLKKILAGSYPSGPSSAEPPLIWQMITNNEIPAYNIPSGILFDMHREAAARRPGVLTKVGLDTFVDPKRQGTAMNDKAREAPVVKRVSFEGEDWLYFPAIAPQVAIIRATTADERGNLTYEHEGATLGGLDQALAARNNGGIVIAQVKRIAREGTLKPHDVRVPGVLVDYIVVDPDQKQTTQTLYDPAISGEIFRPLDTFRLPEFNIQKAIARRVAQELQAGSAVNLGFGISANVPRILLEEGLHGAVTWVIEQGAVGGVPLLDFAFGCASNADAYMPSPYQFTYFQGAGFDASLLSFLEIGRDGSVNVSKLSFRPHVTAGAGGFVDITARAKKIVFSGPRGVEQGQDVTYVTERAVMKLTPQGIVLTEIAPGVDLQAHILDQAEFPLIVSDQLKLMDEALFREEPIGLTLPQKPARKLEA

SEQ ID NO: 13978 - protein, 228 aa, Brucella melitensis 16M
MLNKLSAEFFGTFWLVFGGCGSAILAAAFPELGIGFLGVALAFGLTVLTMAYAVGGISGGHFNPAVSLGLTVAGRLPAKDLIPYWVAQVLGAIAAAAILYVIASGKDGFSAGGLASNGYGELSPGGYSMMAGLLIEIILTAFFIIIILGSTSSLAPAGFAPIAIGFGLTLIHLVSIPVTNTWVNPARSTGVALFADTAALSQLWLFWVAPLVGAVIGAIIWKGLLGRD

SEQ ID NO: 13979 - protein, 336 aa, Brucella melitensis 16M
MRDSNGEYAMNKPLGSKDAEAAGRGRIYDSILDTIGNTPLVRIDKFARENGVKANLLVKLEFFNPLASVKDRIGLAMIEALEKQGKAVPGKTVFVEPTSGNTGIALAFAAAAKGYRLILTMPETMSMERRKLLRLLGAELVLTEGAKGMKGAIAEAEAIAEGNPNAIIPQQFENPANPEIHRLTTAEEIWNDTNGEADILISGIGTGGTITGVGQVIKARKPSFKVVAVEPKDSPVLSGGAPGPHKIQGLGAGFAPKTLDTGIYDEIVQISNEDAFTNARLVARLEGIPVGISSGAALAAAIEVGKRSENAGKNIVVVIPSFAERYLSTALFEGLE

SEQ ID NO: 13980 - protein, 427 aa, Brucella melitensis 16M
MTAPRPSKIRLGNHLLHPETQMLNYGYDSELSEGAVKPPVFLTSTFVFKTAEDGRDFFDFVSGRKEPPAGVGAGLVYSRFNHPNSEIVEDRLAVYEGAESAALFSSGMSAIATTLFAFVRPGDVILHSQPLYGGTETLLAKTFFNFGVEAVAFADGVHEATIEKAAEEALAKGRVSVILIETPANPTNSIVDVAAVRRVAEKIEARQGSRPVIACDNTLLGPVFQKPLDHGADLSVYSLTKYVGGHSDLIAGAVLGAKSVVRQVKALRGAIGTQLDPHSCWMLGRSLETLGLRMERADSNARAIAEFLRNHPKVEKLHYLPFADERSDIAALFKRQCTGAGSTFSFDIKGGQAAAFRFLNALQILKLAVSLGGTESLASHPAAMTHSGVPVDVRERIGVLESTIRLSIGIEHPDDLIADLAQALDAA

SEQ ID NO: 13981 - protein, 337 aa, Brucella melitensis 16M
MTDKLTSAPKHGHTSMLYSKVHTDLDTLDAHIAFLGIPYGSAYTIDEVTNDQTRAPTAVRQATDRAVRNLDRYDFDVDGPLYDGRAIKAVDCGDVVGDPKDPGAHYRNAEAAVRKILAAGVLPLIIGGDHGIPIPVLRAYDDQGPITLIQIDAHLDWRDHINGVHDGLSSPIRRASEMAHVKDIFQIGIRAQGTARPEEYEAARAYGSNIITAYELHDVGMDAILDRIPDGGRYYITIDADGIDPSVMPAVAGPAFGGVTYAQTRKLLHGLVKKGRVVGMDIVEITPSKDVNQLTAIAAGRFFVNLIGAAVRADYFGTKAELETAAGKTMKPAHAAA

SEQ ID NO: 13982 - protein, 271 aa, Brucella melitensis 16M
MTSPLLRISNLAKSFGNVTALRDISFDVSAGEVVCIIGPSGCGKSTLLRCINHLTAPDGGFVEVGGEYIGRERKPDGTVRMQSHHEIDLMRPKMGFVFQQFNLWPHLSVLENIVKGPIKVQKRPRAEAEAQALALLQRFGLRDKAHMFPAGLSGGQKQRVAIARALAMGPELMLFDEPTSALDPEIVKEVLLFLRELADSGVTMVIVTHEIGFARHVADRIVFLDKGVVTETGPSEDVLSNPANPRLREFLSQISSNHSHAGGAFSPAATH

SEQ ID NO: 13983 - protein, 467 aa, Brucella melitensis 16M
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGINYKVGKFPFTANGRARAMLHTGGFVKILADKATDRVLGAHILGYNAGEMIHELAVLMEFGGSSEDLARTCHAHPTMSETVRESALATFAKPIHM

SEQ ID NO: 13984 - protein, 178 aa, Brucella melitensis 16M
MSEHKGPTGAMVDPESLPYRPCVGLMVLNKAGLVWAGRRIVIPGDEMDGATQLWQMPQGGIDKGEDPAQAALRELYEETGMTSVSLLEEASDWINYDLPPHLVGLALKGKYRGQTQKWFAYRFEGDESEIAINPPPGGHTAEFDCWEWKPMADLPNLIVPFKRKVYEQVVATFRHLAA

SEQ ID NO: 13985 - protein, 478 aa, Brucella melitensis 16M
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVITDDAHDLEDMVNHACEIVFHEEFGKAGDRVIITAGVPFGTPGATNMLRIAYIGADGKSGI

SEQ ID NO: 13986 - protein, 336 aa, Brucella melitensis 16M
MTMMAELPSLMTAIEITEPGGAYMLRPAQRAVPEPKEGEILVRVRAAGVNRPDVLQRQGQYAPPPGASDIPGLEIAGDIVALGHGVKRFRKGDQVVALLAGGGYAEYAVVHESNALPLPSGFGYIEAAAIPETFFTVWHNVFERGGLKEGEVFLVHGGSSGIGTTAIQLAKAFGATVITTAGSKEKCDACVKLGADRAINYHEEDFVAVVKEMTGGKGVDVILDMVGGDYVERNYKAAAEDGRIMQIAFLNGAKATANFAILMTKRLTHTGSTLRPRPVAFKAGIARELEAKVWPLLAQRRVAPVMDMIFSLKDAWRAHERMEEGRHIGKIVLDIA

SEQ ID NO: 13987 - protein, 404 aa, Brucella melitensis 16M
MIRTERRNMMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 13988 - protein, 318 aa, Brucella melitensis 16M
MKAIAAFSDFVGRSFAIWVIVFAALGFVMPATFSIFAPWIVVLLGIIMFGMGLTISGKDFAEVAKRPFDVAIGVLAQFIIMPLLAVLLTRIIPMSPEVAAGVILVGCCPGGTASNVMTYPSKGDVALSVACTSVTTLLAPLVTPFLVWFFASQYLPVDAMSMFISIVKVILVPLALGFVLQKLVPGVVKAAVPMLPLVSVVGIVLIVAAVVAVNKAAIAQSGLLIFAVVVLHNCCGLLLGYFAARFAGLSLAKRKAISIEVGMQNSGLGAALANAHFSPLAAVPSAVFSVWHNISGALVASYYARMEDDASETQTSAQ

SEQ ID NO: 13989 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 13990 - protein, 310 aa, Brucella melitensis 16M
MAVRARTKSKGGFIMATIAFIGLGNMGGPMAANLVKAGHTVRGFDLLPQHLEEAKANGLEIAASAAEAVSDVDAVITMLPAGKHVISVYEDIAPKARKDSLFVDCSTIDVDSARKAHELAATHGHLSIDAPVSGGTGGAAAGTLTVMAGGSEEAFKRGEPILQPMAGKIVHCGGDGAGQAAKICNNMILGISMIGVSEAFVLAEKLGLSHQALFDVASTSSGQCWSLTTYCPVPGPVPASPANNDYKPGFAAALMLKDLKLSQEAAKSAGAETPLGAHARELYSRFDDEGHGGEDFSGIINFLRDRTDRA

SEQ ID NO: 13991 - protein, 194 aa, Brucella melitensis 16M [sequence omitted]

SEQ ID NO: 13992 - protein, 510 aa, Brucella melitensis 16M
MQELLEQLEARRAAARLGGGQRRIDAQHGKGKLTARERIEVLLDEGSFEEFDMYVTHRCTDFGMAQQKVAGDGVVTGWGTINGRQVYVFSQDFTVLGGSLSETHAQKICKIMDMAVKNGAPVIGLNDSGGARIQEGVASLAGYADVFKRNVDASGVVPQISVIMGPCAGGAVYSPAMTDFIFMVRDSSYMFVTGPDVVKTVTNEIVTAEELGGASTHTKKSSVADGAYENDIEALEQVRILFDFLPLNNREKPPVRPIFDDPARLEMRLDTLVPDSATKPYDMKELILALADEGDFFEIQEAFAKNIITGFIRMDGQTVGVVANQPMVLAGCLDIDASRKAARFVRFCDAFNIPILTLVDVPGFLPGTAQEYGGVIKHGAKLLFAYSQATVPMVTLITRKAYGGAYDVMASKHIGADINYAWPTAEIAVMGAKGATEILYRSELGDPEKIAARTKEYEERFANPFVAAERGFIDEVIMPHSSRRRIARAFASLRNKQQSAPWKKHDTIPL

SEQ ID NO: 13993 - protein, 254 aa, Brucella melitensis 16M
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 13994 - protein, 425 aa, Brucella melitensis 16M
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 13995 - protein, 394 aa, Brucella melitensis 16M
MSRAAFAWEDPFLLEEQLTEDERMIRDSAKAFASDVLLPRVEKAYLEETTDPELFHLMGQAGLLGVTLPEDYGAANASYVAYGLVAREVERIDSGYRSMMSVQSSLVMYPIYAYGSDEQRKKYLPGLVSGELIGCFGLTEPDAGSDPAGMKTRAEKIDGGYRLSGSKMWISNSPIADVFVVWAKSAAHDNAIRGFILEKGMKGLSAPKIGGKLSLRASITGEIVMDGVEVSEDAILPNVSGLKGPFGCFNRARYGISWGVIGAAEDCWFRARQYGLDRKQFNKPLAGTQLYQKKLADMQTEIALGIQASLRVGRLFDEGKMAPEMISIVKRNNCGKALDIARQARDMHGGNGIQIEYHVMRHAQNLETVNTYEGTHDVHALILGRAQTGIQAFF

SEQ ID NO: 13996 - protein, 342 aa, Brucella melitensis 16M
MFNSVLDTIGNTPLIRLSKASELTGCDIYGKAEFLNPGQSVKDRAALYIIRDAEKRGLLRPGGVIVEGTAGNTGIGLTMVAKALGYRTAIVIPETQSQEKKEVLRLLGAELIEVPAAPYRNPNNYVRLSGRLAEQLAKTEPNGAIWANQFDNTVNRQAHIETTAQEIWRDTSDQIDGFVAAVGSGGTLAGTAIGLKERNHNIKIALADPHGAALHAFYTTGELKAEGDSITEGIGQGRITANLEGFTPDFSYQIPDAEALDILFALVEEEGLCLGGSSGINIAGAIRLAKDLGPGHTIVTVLCDYGNRYQSKLFNPAFLRGKSLPVPRWLEKKTEIDIPFEG

SEQ ID NO: 13997 - protein, 287 aa, Brucella melitensis 16M
MVMENGIDTQSQPQEDQNHQTGVPMISVRDVTVSFGHQTVLHKLSLDIFQGEVLGFIGPSGSGKSVLMRTILGLNKKQTGDIEILGRNIDKLNEMEKMAIDMRMGVLFQHGALFSALNVLENIQVPMREYLDLSPKLMDELARLKVDLVGLHPDTAEKFPSELSGGMIKRAALARALALDPDIVFLDEPTSGLDPIGAAEFDDLIANLRDTMGLTVYMVTHDLDSLFAICDRIAVLGNKKVLVSGTIEDMLKVDDPWVKAYFRGKRARQIDTSAPSRRRPGNRLQTG

SEQ ID NO: 13998 - protein, 483 aa, Brucella melitensis 16M
MAPPLQNRNLSITLEAGISMTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVNGKKIEG

SEQ ID NO: 13999 - protein, 291 aa, Brucella melitensis 16M
MTNVKVAFLGLGVMGYPMAGHLKAKGGHDVTVYNRTAAKAAKWAEQFGGNYAATPADAVKNADFVFACIGNDDDLRSVTVGADGAFSTMKKDAIFIDNTTASAEVARELDKEAQKRGFHFMDAPVSGGQAGAENGVLTVMVGASEPVFERAKPVIEAYARSVGLMGPVGSGQLAKMVNQICIAGLVQGLAEGIHFGKKAGLDIEKLIAVISKGAAGSWQMENRSSTMNQGKYDFGFAVDWMRKDLGICLDEANRNGALLPVTALVDQFYKEVQKIGGGRWDTSSLLARLEQ

SEQ ID NO: 14000 - protein, 272 aa, Brucella melitensis 16M
METGFWIKTRASKHLERFQRFRFNRNRSRIFAVPVIRASHAAKETIAMRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 14001 - protein, 434 aa, Brucella melitensis 16M
MGTQEEIMSKRSPGIETLAVHAGAKPDPATGARATPIYQTTSFVFEDADHAAALFGLQAFGNIYTRITNPTTAVLEERIAALEGGTAAVATASGHAAQFLAFHTLLQPGDNFIAARQLYGGSINQFGQSFKSFDWQVRWADATNPADFAKQIDERTRAIFIESFANPGGIVVDIEAIAEIAHRNGLPLIVDNTLASPYLVRPIEHGADIVVHSLTKFIGGHGNSMGGILVDGGTFDWAKSGNYPLLTEPRPDYAGLELHKTFGNISFAIAARVLGLRDFGPAISPFNAFQILTGVETLALRMQRHSDNALKVATWLHGHEKVSWVNYAGLPHDKYHALQQKYAPKGAGSVFTFGIKGGYEAGVKFVDSLELFSLLANLGDTRSLVIHPASTTHRQLSDEQKVAAGAGPDVVRLSIGIEDADDIIADLEQALAKA

SEQ ID NO: 14002 - protein, 316 aa, Brucella melitensis 16M
MPSKTIDHAITARSLTSAATDPTHAGVLSFMRRTYSKSLKGAEAVVWGIPFDAAVSNRPGARFGPQAIRRASAIFDNDPQYPFERDLFENLAVIDYGDCLLNYGNHTKTPSTIEREAAKILKSDAFLLTLGGDHFITWPLLKAHTAKYGPLALVQFDAHQDTWFDDGRRIDHGSFVARTARDGIIDPDLSIQIGIRTHAPEDCGIRIIYGHEVEDMPAAAIADAILKRTNGRKAYLTFDIDCLDPAFAPGTGTPVAGGPSSAKMLSVLRKLTALDFVGADVVEVAPAYDHADITAIAGATIAMYYLGLLGERKERR

SEQ ID NO: 14003 - protein, 442 aa, Brucella melitensis 16M
MHPACARLIQEVRVPTKNAIEALFAEANLVPSRQNHVFRESVEQHATWSGGIFVAKQQLKTEKLGINTRLAHDGYCPGDYHGFVNPPVVRASTVLFPDAETMASNGQKYTYGTRGTPTSEALCKAIDALEGSAGTVCVPSGLAAITVPLLGFLSPGDHALLVDSIYYPTRHFANTILKRMGVDVEYYDPEIGADIAKLMRPNTKVVFTESPASNTFEIQDIPAIAEAAHKGNAIVMMDNTWATPLYFRALDFGVDISIHAATKYPSGHSDILFGTISTNEKCWPQLLETHGTMGLCAGPDDTYQILRRLRTMGIRLEHHRKSALEIARWLENHPMVERVLHPALESHPGHEIWKRDFSGSSGIFSFVLAKGEHAQASAFLNALEIFGLGYSWGGYQSLALEVKLGDRTVSKNDYAGAVIRLQIGLEDVPDLIADLERGFAAI

SEQ ID NO: 14004 - protein, 500 aa, Brucella melitensis 16M
MPYCPIALHKETTMKAQPKASHFIGGAFVEDKAGKPLPVIYPATGEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 14005 - protein, 474 aa, Brucella melitensis 16M
MREMLMRPVVLAGGKGTRLWPMSRSQRPKQFLALTGELSLFQMTLKRLSDPNRYSSPIIITNADYRFLVAEQALECGVELSDVILEPMARNTAPAIAAAALIASKDEQTLIHVVASDHNIEINDAYFQAVDTACNAARMGRLATFGITPTEPATGFGYIEAGELEESGACAIKRFVEKPKEEVAREMLAAGGFYWNSGMFLFRSDVFLDECRRYAPAVYEAAEASVATAQRDLDFVRLNSAEFEKAPDISVDYAIFEKTKLASVVPSPIHWSDLGSWDAVWKESKQDPSGNVARGPVSLHNTNNSLVLSEGVHVAVNGVDDLTIVASEDALYVGKLSEAQGVGTIVKALMKQPATAKLAEEHRTIYRPWGGYTHLLSGDRLQVKRLFIKPGKQLSLQKHHHRSEHWVVVRGVAEIVIDDKSLFLSENESTYISQGAIHRVSNPGKILLELIEVQTGAYLGEDDIVRFEDDFGRV

SEQ ID NO: 14006 - protein, 467 aa, Brucella melitensis 16M
MAKTRVQFICQNCGAVHSRWAGKCDSCGEWNTLIEEGTNSGIGSGPGAMLSKRKGRAVALTSLSGEIEDAPRIISGISELDRVTGGGFVRGSALLIGGDPGIGKSTLLTQAAAALSNRGHRIVYVSGEEAVAQIRLRAQRLGVAASAVELAAETNVEDIIATISSDNSGSKRPDLVIIDSIQTLWTDMADSAPGTVTQVRSSAQAMIRYAKQTGAAVVLVGHVTKDGQIAGPRVVEHMVDGVLYFEGEGGHHYRILRTVKNRFGPTDEIGVFEMSDGGLREVSNPSELFLGERNEKSPGAAVFAGMEGTRPVLVEIQALVAPSSLGTPRRAVVGWDGGRLAMILAVLESHCGVRFGQHDVYLNVAGGYRISEPAADIAVAAALVSSMAGIALPPDCVYFGEISLSGAVRAVSHPVQRLKEAEKLGFRQAEVPNGSGELWKDRNFRLMETAALADLVARIAASGAGKK

SEQ ID NO: 14007 - protein, 313 aa, Brucella melitensis 16M
MRDPYSVLGVAKTAKPEEIKSAFRKLAKKHHPDQNQDDPKAQERFAEVNQAYEIIGDKDKRAQFDRGEIDVEGKPVFQGFAGGQGFGGAHGDPFAGFRQGGGNSHFEFRGGPGGFQGGGFGGAEDILNDLFGGAFGGGRSGARQRGPSKGADLSASIDISLSQAVGAEKVEAIFPNGKHLKIKLPKFVEDGQTIRLKGQGEPLMGGTPGDALVTIRFKPHSRFRLEGRDVHVDLPVSIDDAVLGGKQEVETLDGRISVKIPAWSSSDRVLRLKEKGLPLKAGGRGDLYVHVRIMLPEGGDKELEDFLQKRRVV

SEQ ID NO: 14008 - protein, 401 aa, Brucella melitensis 16M
MEKMTTENARKFRPATELVHAGSLRSGFAEMSEALFLTQGFLYPTAEAAEARFKGEDPGFIYSRYANPTTDMFEKRMCALEGAEDARATASGMAAVAAAILCQVQAGDHVISARAVFGSCRYIVETVLPRYGVEVSIIDGSDVANWKAAVRPNTKVMFLESPSNPTLEIIDIAAVAQIANEAGAKLIVDNVFATPLFQKPLELGAHIVVYSATKHIDGQGRCLGGVVLSDREWIETTLQDYFRHTGPGLSPFNAWIMLKGLETLSVRVRQQTQSAAAIADFLAGKPGVKRVIYPGRADHPQTDIIAKQMTGGSTLIALELEGGKEAAFKFENALQIFSITNNLGDTKSLITHPATTTHKNLSNEAKAELGISDGLLRVSVGLEDTDDLLEDVEVALKVARG

SEQ ID NO: 14009 - protein, 498 aa, Brucella melitensis 16M
MKHTGSAGSSSIDAGSPDIRGARLPAGDYAHVFDDLHPPLSPHEAIVESDRCYFCYDAPCMNACPTGIDIPLFIRQINAGNPAGAARTILAENILGGMCARVCPTETLCEEVCVREVAEGKPVKIGHLQRYATDMLMATGNHPFTRAAETGRHIAVVGAGPAGISAAHRLAMHGHQVTIFEARPKGGGLNEYGIAAYKTVNNFAQRELDFVLQIGGIHIEYNQTLGQDITVEALKAGYDAVFLAMGLPGVNDLGLAGEDAPNVLDAVDYIANLRQARNLSTLPVGRDIVVIGGGMTAIDVAIQTKKLGANNVTIVYRRGQESMNASAYEQELAQIHGVVIRHWLQPHALERSEDGIVHAITFEYTANRDGKLVGTGEYLTLDADQVFKAIGQTFDPEPLRGSGIALAKGRISVDAEGRTSVEGIWAGGDCVAGGKDLTVASVEDGKVAALSIHAALTSRPEAVEGFAEAVLSGAAHHAPAAPSRHATVQPGSEQGLGD

SEQ ID NO: 14010 - protein, 363 aa, Brucella melitensis 16M
MAQLSIKNLVKRYGSIEVVHGINLEIADKEFVALVGPSGCGKSTTLRMIAGLESISGGTLEIGGKVVNDLPPRDRNISMVFQSYALYPHMSVRENMGFSLKIAKQPQAEIDRRVNEAAAVLGLEALMDRRPAQLSGGQRQRVAMGRAIVRNPEVFLFDEPLSNLDAKLRTQMRTEIKKLHAKVQSTVVYVTHDQVEAMTLADRIVIMRDGHIEQAGTPDEVFKRPATQIVAGFIGSPPMNMAEATVKGDELLFANGDRLPLPARFKARVGEGAKVTFGLRPDDIFPKGHGLSTGDGVHEKELRVVITEPLGNETLVFAEFAGREWVARMLNPRPVQPGESIAMQFDLAQAHLFDAATGKSLTV

SEQ ID NO: 14011 - protein, 373 aa, Brucella melitensis 16M
MWQPAVSSPASLMLVSSHSPGTMQVRQRRSNSMAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 14012 - protein, 505 aa, Brucella melitensis 16M
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMEKALKRVEAIVQGDPLDPATMIGAQASSEQLEKILSYLDIGRQEGAEVLAGNERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENHLKMLDHYQNTKNMLVSYSPKKLGFF

SEQ ID NO: 14013 - protein, 370 aa, Brucella melitensis 16M
MKSRAAVAWEAKKPLTIETVEIGGPKAGEVLVEIMATGVCHTDAYTLSGLDSEGKFPAILGHEGAGIVREVGADVTSVKPGDHVIPLYTPECRQCKTCLSQRSNLCTAIRATQGQGLMPDKTSRFSCDGGEVFHYMGCSTFSNFTVLPEIAVAKVREDAPFDKICYIGCGVTTGIGAVIYTAKVRPGSNVVVFGLGGIGLNVIQGARMVGADKIIGVDINPAKVEMARKFGMTDFINPREIGNDKVVQAIQDLTDGGADYSFDATGNTDVMRQALECCHRGWGESIIIGVAEAGKEIATRPFQLVTGRVWKGTAFGGARGRTDVPKIVDWYMEGKINIDDLITHTMPLDEINTAFDLMHEGKSIRSVVIY

SEQ ID NO: 14014 - protein, 308 aa, Brucella melitensis 16M
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRVKRMIALADIVKLSDEDLDWFGEKGSHDEIAAEWLKLGPKLVVITKGAHGAVAYTNHATVPVPGVKVDVVDTVGAGDTVNAGILASLHSQGLLTKDALANLSEDQIHSAVALGVRAATVTVSRAGANPPWAHEMRD

SEQ ID NO: 14015 - protein, 404 aa, Brucella melitensis 16M
MATNWQAAETGIEFAGASMLPFGRSRDGGAMKQAWPRRRQGKGLGMEVRVAGVRKEFARFPALHNVSLTIQSGELIALLGPSGSGKTTLLRLIAGLETPTEGMIFFGDEDASQKSVQERNVGFVFQHYALFRHMTVADNIGFGLKVRPGGTRPSTAEIRRRALELLDLVQLSGLEKRYPAQLSGGQRQRVALARAMAIEPRVLLLDEPFGALDAQVRKELRRWLREIHDKTGHTTVFVTHDQDEALELADRVVVMSQGRIEQVGTPDEVYDKPNSPFVYGFIGESSTLPVRVENGEVWLADRNIGLGAENMPDGDAQLYFRPHDVELLDGCGGCIAGTVIASRRSGGKRRVELEVGGARERIEIEIPAEHPAAEKSRIAFRPRYWTLFRAGDSELPAPKAAATT

SEQ ID NO: 14016 - protein, 290 aa, Brucella melitensis 16M
MGTMKTNRISFQGEAGANSDTACRNMFPDMEPLPCPTFEDAFNAVETGAADLAMIPIENTLAGRVADIHYLLPLADMHIVGEYFLPIHFQLMVLPGVRREEIKTVHSHIHALGQCRNVIRQNGWKGVIAGDTAGAARLVADVKDRSMAALAPRLAADLYGLDILEENVEDSENNVTRFVVLSKNKQWAARPENDERIVTTFVFRVRNVPAALYKALGGFATNGVNMTKLESYQLGGRFIATQFYADIEGHPEERSVQLALEELRFFTKEVRILGVYKGSDIRGTQLLAAE

SEQ ID NO: 14017 - protein, 303 aa, Brucella melitensis 16M
MDGNGNGWQACCRLSRTHFATGHGMTTRIDTKFAELKAEGRPALVTYFMGGDPDLETALKVMKALPKAGADVIELGMPFSDPMADGPAIQAAGLRALNAGQTLAKTLYMAAEFRKEDDTTPIVMMGYYNLIYIYGVERFLTDAKASGVDGLIVVDLPSEMDAELCIPAMKAGINFIRLTTPTTDDKRLPKVLHNSSGFVYYVSMNGITGAAIADTAKVGEAVRHIKKSTDLPICVGFGVKTPEQAAAIATHADGVVVGTAIVNAIAGELDEKGKAKGDPVAAATRLVHALAESVRATRLEAAQ

SEQ ID NO: 14018 - protein, 491 aa, Brucella melitensis 16M
MKETGIHNKAASISTSGLKELSAVFYNLGPARLYEETIRRGEAELSAQGALVARTGQHTGRSPKDKFVVRDANTEDHVWWDNNKPMTPEAFELLYADFIEHAKGRELFVQDLIGGADADNKINARVITEYAWHSLFIRNLLIRPSQEALASYVPEMTIIDLPSFKADPERYGVRTETVIAVDLTRKIVLIGGTSYAGEMKKSVFTALNYILPAKGVMPMHCSANEGPNGDTAVFFGLSGTGKTTLSADPTRTLIGDDEHGWGEHGVFNFEGGCYAKTIRLSAEAEPEIYATTQRFGTVLENVVLDENRQPDFDDGSLTENTRCAYPLDFIPNASKSGKGGQPKNIIMLTADAFGVMPPIAKLTPAQAMYHFLSGYTAKVAATEKGVTEPEATFSTCFGAPFMPRHPSEYGNLLRKLIAEHKVDCWLVNTGWTGGAYGVGKRMPIKATRALLAAALDGSLNNAEFRIDPNFGFAVPVEVPGVESSILDPRST

SEQ ID NO: 14019 - protein, 497 aa, Brucella melitensis 16M
MCLKRHIGEGAATRIRAQCDYAFTNIRGACMNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVPGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGGRASVVMVFIFFAFVLWALTQEPDTLAAMKVTPLWFVLLGIAYWVMKLKQKQS

SEQ ID NO: 14020 - protein, 499 aa, Brucella melitensis 16M
MAHGIASLAQREENNMGKVTGFLEIDRQVAKYQPASDRIRHFREFTIPMTDGEVQKQAARCMDCGIPYCHGPTGCPVHNQIPDWNDLVYNNNWDQAIRNLHLTNNFPEFTGRICPAPCEEACTLNLEDMPVAIKTVEQALGDKAYELGYIVPQPAASKTGKLVAIIGSGPAGLAAAQQLARAGHMVDVYERESRPGGLLRYGIPDFKMEKHLIDRRVAQMEGEGVRFHCGVNIGVDKPLRGLLDTYDAVLYCGGSETPRPAGIPGADLDGVHDAMPYLVQQNRRVGRENIESVAWASVPILAGGKHVVVVGGGDTASDCVGTAFRQGAVNVTQLDIRPQPPEKEDKLSVWPYWATKMRTSSSQAEGASREFQVATLEFIGEDGRLTHVKCCQVDEKRRPIAGTEFFIKADLAFIAIGFAGPVEDSVVKEMDGKLEIATDRRGSKSVKANDRDYRTNVDKLYAAGDIRRGQSLVVWAIREGRQAAHAIDADLMGSSVLPR

SEQ ID NO: 14021 - protein, 443 aa, Brucella melitensis 16M
MFLRSMLAFPPRRDNDMSGNQELIARRERLLGRNMSLFYQDPVHLVKGEGVWLWDADGRKYLDCYNNVPHVGHCHPRVVEAICRQASTLNTHTRYLHEGILDYVERLTATFDKSLDAAILTCTGSEANDVALRMAQAVTGKTGIIATDFTYHGNTTAVSQLSTRMPPVGGYGGHVRHVPAPDSYRPLGGKGGEAFAQAWAAEVEKAIASLQESPFGFSGLIIDPFFANEGFPDLPENFLAPAVAAVRKAGGVVIADEVQPGFGRTGGHMWGHQKAGIVPDIVTLGKPMGNGHPVGAVVAGADTLNAFRKAFRYFNTFGGNPVSCAAAMAVLDVLEEEKLQANALEVGAYARQGLEKLAQKHGMIGNVRGSGLFFGAELVLDRAEKTPAAEMATRVVNEMRERGVLMNKLGIHQNATKIRPPMPFSRENADLMLSTLDDVLGGL

SEQ ID NO: 14022 - protein, 504 aa, Brucella melitensis 16M
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVEFMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 14023 - protein, 411 aa, Brucella melitensis 16M
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKHAGERLRSGLDAQAARYGFDLLQTGPAVMPLVQFTGDSDAALGARFCQEALKQGVYLHHKHNMFISCAHTDDVIDDALSRTEDAFKAISTK

SEQ ID NO: 14024 - protein, 382 aa, Brucella melitensis 16M
MIYHCRQKRRKQVIVNTTKMTGENMDSQKISRDSGLGISIEGVTKKYGSFTAVDGLDMQIAPGEFLALLGPSGSGKSTILMLLAGFERPDNGRILFGNNDYTRVPPHRRNIGMVFQHYTLFPNMSVLDNVAFPLKTRGMERSQRHRIAREALARVRLADFADRSPKQLSGGQQQRVALARSIVYSPRVLLMDEPLSALDKNLREEMQIEIKRLHTELGMTIVFVTHDQGEALTMADRVAILQGGHIQQIAGARELYNRPANLFSARFIGEMNLIPVDWDGQTARTTDGTTVPVPAHNVMNASTGKALIAIRPERLAPAGQGLEITVRDVIYAGPDTAVLETMADGTELRARLASAALPDIRSGQKLYLGFSPEAGLLYRPAE

SEQ ID NO: 14025 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 14026 - protein, 228 aa, Brucella melitensis 16M
MKPKRRKAGWKMWPAKAEIRYVPLGVIGVIAPWNYPVNLALAPLVAAIAAGNHVFLKPSEHTPRTAAFLKSLLADVFPEDRVAVALGDAALSAQFSALPFDHLFFTGSTAVGRKVMAAAAQNLTPVTLELGGKSPAIISENVNLKRAARAIATGKFFNAGQTCIAPDYVLVHHSKRDEFVALLRAEMEARYSSPSAEKDRTTIINEAQEMRLAGLLADAGEKSEAIID

SEQ ID NO: 14027 - protein, 217 aa, Brucella melitensis 16M
MTDSSHQRSTAMSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 14028 - protein, 369 aa, Brucella melitensis 16M
MQHAAVCSGTSRHRRTTVTIEKPPATSAPIVEMKDVRRMFGETAAINGVSLSVARGEILGIIGRSGAGKSTLIRCVNGLEKPDTGSIHIEGREITSLDEDALRPVRRRIGMVFQHFNLLSAKTAAQNIALPLKIAGMPKAERIKRVAELLELVGLSDKASHYPAQLSGGQKQRVGIARALAAEPAVLLSDEATSALDPETTQSILALLKDINAKLGLTILLITHEMDVIRRIADRVIVLDHGLIAEEGPVWKVFANPQSPVTQSMLQVLTPELPAIWRNRLEKKGDQAILRVKLSGMAAKGAFFNDVAAATSLAPQLIHGGMDTIQGEPVGTLFIGLPAEDKTKLKAAIGYLNTHADATEVLGYVSGNA

SEQ ID NO: 14029 - protein, 423 aa, Brucella melitensis 16M
MRKEMLLPNLSISYSDPIKFVRGDGVWLIDNRGRAYLDCFNNVCHLGHAHPEVVEAIARQAAILNTNTRYLHDTIVSYAERLTATLPEGLTVASFACSGSEANSLALRMARTHSGQRDALVLDWAYHGTTQELIDLSPYKYKRKGGKGRPDHVFEATIPDSYRAPESWPLAEHGRRFAESIAEQIEKMKAQGRAPAFFIAESIPSVAGQVFLPEGYLREVYAMVRAAGGVCIADEVQVGFGRVGSHWWAFEMQGVVPDIVTMGKPIGNGHPMSAVVTTREVADSFNNGMEYFNTFGGNPVSCAAGLAVLDVIEHNDLRRNALEIGNYLIAGFRSMQDRFDIIGDVRGQGLFLGIELVMDRKTKEPATAIARKINDGARERGILMGTEGPFDNVLKMRPPMIFTRANADHLLSVLEDSFAAALK

SEQ ID NO: 14030 - protein, 371 aa, Brucella melitensis 16M
MASLFDPITIGDLKLANRIVMAPLTRNRSPHAVPNDLNVIYYEQRASAGLIITEATPISQQGQGYADVPGLYSAEQLAGWRRVSDAVHNAGGKIVAQMWHVGRISHNSLQPNGEKPVAPSAITAKSKTYLVHPDGAGEFVPTSEPRALEKSELPGIVADYARAAKDAVETAGFDGVEIHSANGYLIDQFLRGGSNQRTDEYGGSIENRARFLFEVVDAVTKAIGAGKVGIRLSPVTPANDASDPDPQPLFDYVIGKLAACGLAYIHIIEGATGGPRDFQQGPQPFDYARFKQVYRDAGGKAAWMVNNGYDRKMAEEEVEAGRADLVAFGKPFIANPDLVRRLKENAPLNELDQKHMYGGGAKGYTDYPVLA

SEQ ID NO: 14031 - protein, 331 aa, Brucella melitensis 16M
MPIRLVHIAKHKWSILIQILEGIQFMHCKILGLPVQEGTGRKGCNMGPDSYRAAGIADAIRELGHECTDLGNLAPAAQRPLQHPNHAIKALPYAVAWIEAISEAAYRESAEGFPIFLGGDHLLAAGTVPGIARRAAEKGRKQFVLWLDAHTDFHTLETTTSGNLHGTPVAYYTGQKGFEGYFPKLAAPIDPHNVCMLGIRSVDPAEREAVKKTEVIVYDMRLIDEHGVAALLRRFLERVKAEDGLLHVSLDVDFLDPSIAPAVGTTVPGGATFREAHLIMEMLHDSGLVTSLDLVELNPFLDERGRTAAVMVDLMASLLGRSVMDRPTISY

SEQ ID NO: 14032 - protein, 256 aa, Brucella melitensis 16M
MTKFWIGTSWKMNKTLAEARLFAEALKAADAGRSPDIQRFVIPPFTAVREVKEILSGTSVKVGAQNMHWADQGTWTGEISPLMLKDCNLDIVELGHSERREHFGETNETVGLKVEAAVRHGLIPLICIGETLEDCESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 14033 - protein, 484 aa, Brucella melitensis 16M
MKSTIHSEGAAVSASVANHTPKPPLLSVDDAKALDLPRMTELFTAHLNPGQLHFMKLLGFHKVKVERAEGMYYYDQNGRRILDFFGGFGSLAFGHNHPRIIAARRKFQEELRHEIAIAFMSQYAAALAYDLAACSPGDLDMVFLGSSGSEAMEAAIKVAERAAGPKKPKIVYAENSFHGKTKGVLSITDGGLYRGEFKLVDNTVRVPFGDITAIENAFRSDPEIGTIVLETVQGGCGIIQADAEFWQKLRQLCDRYGVIWVADEVQCGFGRTGKFYAFEHYGVIPDVTALAKSLGGGKAAMAAMIARRDIYMKAYGTPKTAMIHAMATFGGIGEACITAIEAVNILYDEQLIDNSAEVGDYLLERLKELQVRYPGLLKDVRGKGMMVGLEFHDFSQAMPMVLRPMLAMLDDKLKGSLPGFIGSHLLRDHGVLVAFTEYNRNVIRLEPPLICQRAHVDEFIKALDEVLSRGIVKIVKDFIKAQIK

SEQ ID NO: 14034 - protein, 336 aa, Brucella melitensis 16M
MGHIMHSKALRCRSARVSSLHCLGPSGCGKSTALNCIAGLLATTGGGVYIDEKRIDTLKPEDRGFGMVFQNYALFPHMSVRENVGFGLKMRGTPKSEIRKRVDEAIGMVRLNGQEEKLPGQLSGGQQQRVAIARAIVIEPPLVLMDEPLSNLDAKLRLEMRAEIRRIHNQLGSTTIYVTHDQDEALSLADRIVVLRDGEIRQVGVPSDLYERPDHLDVAEFMGYRNRLPGKVTAIDGERATISIGGSLIAGIARVPLAIGQDVVLAARPDDVATGPASPAALQAKVETIEYRGRDFVGTANMSDGHNLVFHASAHAELGSAVSLTVDPNRALIFPA

SEQ ID NO: 14035 - protein, 476 aa, Brucella melitensis 16M
MSADTTEKKATRTPRRRTPAYVKSLRGVKNWKQATEWLAWRDIEDIECITPDQAGVARGKMMPSKKFTSNTSLALPSAVFMTTISGAYPEDGYGFHYPEDDGDLKLLPDLTTLSAVPWETDSTAQVICDLVYQDGRAVEFTPRNVLRNVIAAYSKRGLKPVVAPEIEFYLVRKNPDPDYPLTPPVGRSGRAIGGGQGYSIAGVNEFDELIDDIYHFSEGQGLEIDTLIHEEGAGQLEINLRHGDPVELADQVFMFKRTIREAALKHDMYATFMAKPIQGQPGSAMHIHQSIVDKKTGRNIFTNEDGSESQAFHHFLGGMQRHVPNALVMFAPYVNSYRRLTPDASAPVNVKWGYDNRTTAFRVPRSDPSARRVENRIPSSDANPYLALAASLACGLIGLVNKIEPEQPATTSVNTKEVELPRGLIDAVELFEEDAELRNLFGSSFMTTYAAIKRAEFETFMEVISPWEREFLLLNV

SEQ ID NO: 14036 - protein, 434 aa, Brucella melitensis 16M
MLACIVDMQGRLIGKRFYGQFFVESGYDETHGCNYLLADDIDMEPVPGYEAAGWDKGYGDFVMKPDLSTLRLAPWLEKTAIVLCDVLDHHHDDLSHSPRAVLKKQVQRLHERGYRAYFASELEFYIFDETYKSARAKRWHEMETASPYVQGYVIHLTTREEPVLRAMRNHLADAGIPVENSKGEWGPGQQELNVRYCKALEMADRHVIMKNAMKEIAEAHGKCITFMAKYDYARAGSSSHVHNSIWSADGKEPLFFDPKAPYTMTPLMRSWVAGQIKYATDYTYFLAPYINSYKRFQAGTFAPTKIMWSQDNRTAGFRLCGEGTKGIRIECRIGGADINPYLAFAALIAAGLKGVDEKLELDEPFVGDAYSAVRLKEIPYTLREAAAALKGSAFLKEAFGEDVVNHYTHTAHWEQIEYDRRVTDWELYRGFERY

SEQ ID NO: 14037 - protein, 465 aa, Brucella melitensis 16M
MSGNFGGPMDDRCIIIGAGHAGSQAAVSLRQEGYAGEIILINDETDIPYHKPPLSKSYLKAPEKGSLVLRPESAYRDNNIEMLFGAHVDAVSIAERTVTLGDGRVLPWSELVFATGARARIPDVPGVALEGVVTLRRMEDARRIAAMMPDVRNVVIIGGGFIGLEMAHSAIALGKKTVLIEAAPRVLGRSVAAPVSAHVEARSRAADITLLTGLGVASIEGENGRAIGVTAGDGTFFPADLVVIGTGAVPNVELAAKAGLSIDNGIRVDEHMRTSAPHVYAIGDCASYAHFHAGRHVRLESVQNATDQAKHFARTIVGRETPYREVAWFWSDQGDMKLQTAGLSFDADRHVLSGEPEENAFSVFSFQGRQAGGGRFHQSPGRSYDCASSACGGDQPKRGRYYGWYAAPQGIAGGCGAIKVLWKRPDLGGGEESVRFLIAEGMGGGETPGDILETEGPRGFIRSQS

SEQ ID NO: 14038 - protein, 1218 aa, Brucella melitensis 16M
MAVFQNFAPPIREQSALRQAITAAYRRPEAECVSALAEQATLPEETRQQIRSTARKLIEALRAKHKGTGIEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPLVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 14039 - protein, 353 aa, Brucella melitensis 16M
MTAIRPGSVTFENVTKKFGNFTALPNLSLTVEPGTLVTLLGLSGCGKTTTLRLLAGLEHPTSGRILIGGKDVTNLPANERDVSMVFQSYALFPHMTSLENVAYGLESSGFKKNEARERAEEGLKLVGLGGMGHRLPAELSGGQQQRVAVARALVLEPQVLLLDEPLSNLDARLRRRVRTEIRELQQRLGFTAVYVTHDQDEALAVSDTIIVMKEGGIAQKGSPRDLYEAPASAFIADFMGEANVVPCEVISAENGEAVIRVAGLTHRVPARNAQPGPAQLAIRPNAVTLQPQAGGGFSGTVAHSAYLGDHIEYEIETEHGKLFIVDPAVEQSLPLQTDVSIQFKTRGLAIINQ

SEQ ID NO: 14040 - protein, 429 aa, Brucella melitensis 16M
MQPRAGPSLPGAKRLPKERIAYIRRIAEIYESRLDEMAKTISMEMGAPIKLARESQAAAGLSHTKAFIAACENFEVEEVLSPKYPNQTVVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTGQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 14041 - protein, 281 aa, Brucella melitensis 16M
MLPGSETCRRGGHVVGRICLGGMMFEKLFKLQEHGTSARTEIIAGVTTFLTMSYIIFVNPDILSTTGMDRNAVFVATCLAAALGSIIMALVANWPIGMAPGMGLNAFFAFTVVGAMGFSWQQALGAVFISGVIFLLLTVTGVRPWLVDGIPHSLRTPLRPVLACSWRLLALKVLVLSSAIRQRWLAWAISRNPARFSPLQVSSSSPFSMRSRFAVQSSSAFWSSPLRPSRSASASLAVFFPLLRASRPPSCSSISWARCIPASSMSFSYSCWLRFSMPPAH

SEQ ID NO: 14042 - protein, 149 aa, Brucella melitensis 16M
MRIAARSLPGSLIGTSSTTAYVESAAGVQAGGRTGLTALVVGILFLAALFISPLAGSVPAYATAPALVYVACLMMRELTEIEWHEVTEAAPAALTALAIPFTYSIANGLAFGFISYVVMKTFTGKVREIHAATWLVAALFVIRFAFFAE

SEQ ID NO: 14043 - protein, 448 aa, Brucella melitensis 16M
MNIRPEAGDVAGMNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQQALN

SEQ ID NO: 14044 - protein, 308 aa, Brucella melitensis 16M
MLVEKTRLGGTCLNVGCIPSKALIHAADEFHRLTTFAAKSPLGITTQNPAIDFARTLEWKDGIVHRLNSGVAGLLKRSRVRMFQGQARFQDGKTVLVDTDTGRQTIHAENIVIATGSVPVEIQALPFGGNIISSTEALSLEKIPERLAVVGGGYIGLEIGTAFAKLGSRVMVVEATDRILPQYDAELTRPVMARLKTLGVEVLTGTSAKGLSADGKALEIRTQDGAVKAIEADKILVTVGRKPQTDGWGLSEIRLDMDGRFIRIDDRCRTSMRGIYAIGDVTGEPMLAHRAMAQGEMVAEIIAGGKHA

SEQ ID NO: 14045 - protein, 424 aa, Brucella melitensis 16M
MNPNTSPVWHPFTQHRLEPRPDRIVRTEGAYLFREDGSAVLDMISSWWVITHGHRHPAIMDAIRQASADLDQIIFADFSHQPAEELAKGLIALAPDGLSHVFYSDSGSTAVEVAIKMALGYFYNRGEPRSRIAVLQHSYHGDTIGTMSAGERGVFNAAYGALLFNVETLPFPSPGHEQPMLDRLEDVCRGGDLAALLVEPLVLGAGGMKMYPAHILATMREITERHGVLLAVDEVMTGWGRTGTLFACEQAGITPDILCTSKGLTGGSLPLAATLCTAAIFDAHYSDDRSKTFFHSSSYTANPIACAAALANLQVWLSEPVTERISALTRMQTERLHRFKDDSRFAGLRQTGTITALELDVPAGGYLSDAGPKLRTFFKQNGVLLRPLGNVIYVMPPYCVTAEELDRTYDVITQGVDMIAGQTR

SEQ ID NO: 14046 - protein, 453 aa, Brucella melitensis 16M
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGCIAAIIMEPARADEPQDNFLHEAMRIAQENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRTLFLQETIRRGVLMPSLVVSYTHSDADIARTIDAVHGALGIYVRALNDGVESCLVGRPSQVVYRRFNEDPASSCPPPRL

SEQ ID NO: 14047 - protein, 375 aa, Brucella melitensis 16M
MKFKAAVLDRHGVERPYNQTKPLVIREVELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 14048 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 14049 - protein, 346 aa, Brucella melitensis 16M
MSCSCFPKVFRMPKAVLSVIATRPGGPEVLELVPRELPALKRGEMRVRIHAAGVNRPDAMQRAGQYPPPPGVTDVLGLELSGVVLEIAEDVTRFGPGDRIMALVAGGAYSEEAIVQADVCIPVPAGLSMVEAAGIPETYFTVWSNLFQRAGLQPGETVLLHGGTSGIGVTATLLAKAIGARMITTCGSDDKCRASEALGAIASINYRTTDFVEAGRALTEGRGPEVVIDMVGGSYMQRNLQLVAEDGRIAQIAFQQGSEAQMDMGPLLFKRLTLTGSTLRARPLVMKAALARSVEAEVLPLVLNKGARPVIDSVFDLADVQAAHAHLEASAHTGKIILKTAACDAA

SEQ ID NO: 14050 - protein, 499 aa, Brucella melitensis 16M
MAMAKIVESPTGALALTFDDVLLQPGHSEVMPGQVDLRTRIAKDIELNLPLLSAAMDTVTESRLAIAMAQAGGIGVIHRNLSPERQAEEVRQVKKFESGMVVNPVTIGPDATLADAQALMKAHGISGIPVVENATKGPGRLVGILTNRDVRFASDPKQKIYELMTRENLITVHENVNQDEAKRLLHSHRIEKLLVVDDKDRCVGLVTVKDIEKSQLNPNAAKDAQGRLRAAAATSVGADGFERAERLIDAGVDLLVVDTAHGHSQRVLDAVARIKKAYPNVAVLAGNVATTAGTQALIDVGADAVKVGIGPGSICTTRIVAGVGVPQLSAIMSAVEAAQKQNIPVIADGGIKFSGDFAKALAAGAVAAMAGSLLAGTEESPGEVYLHQGRSFKAYRGMGSVGAMARGSADRYFQAEVRDELKLVPEGIEGQVAYKGPISAVLHQLAGGLRASMGYVGAKTLEEFREKATFVRISNAGLRESHSHGVAITRESPNYPGGM

SEQ ID NO: 14051 - protein, 471 aa, Brucella melitensis 16M
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETVLEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 14052 - protein, 131 aa, Brucella melitensis 16M
MEAVDIYTRQCSTLVTATDLATMGATLAAGGVNPISGKRMVSAGNVAPILAEMTMEGLYTALGDWAYTVGLPGKSGVGGGIMAVVPGELAIAAFSPPLDPAGNSVKAMAAVAAVADSLGHNLYTTRGKVSS

SEQ ID NO: 14053 - protein, 200 aa, Brucella melitensis 16M
MSSSSDAIKAALEKGRAAGLSATGGKNADYIPFLASVPSDLFGLAVVTADGQTFKTGDADIAFAIESISKVFTLALVMEEIGPDSVREKVGADPTGLPFNSVIALELHNGKSLSPLVNAGAIATASLVPGDTADARWNNILECQCGFAGRRLKLSNEVNQSNRRPIFTTAPLPGCFTVPVLATAIRWRPWIFIRANVQRL

SEQ ID NO: 14054 - protein, 355 aa, Brucella melitensis 16M
MTDYRTRFENISKSYGDFKVIDGLNLDIERGEFVSLLGPSGSGKTTLLMMLAGFENPSSGTIHVDGKSINSVPSYKRNMGVVFQNYALFPHMTVAENIAFPLQMRGVGKAQAAEKVARVLDMVQLSAMSERKPSQLSGGQQQRVALARALVFEPHVVLMDEPLGALDKQLREQMQLDIRALHNRLGLTIVFVTHDQSEALTMSDRIAVFNKGKIEQIGSPRAIYDEPQTRFVAEFIGETNLAEGTVESVEGSRILIRLKDATAIAASSASRPISGQNVLLSIRPERIELGEADGAENRLAARVMDSVYQGDHLRIQLEAKAHNFVVRLDRKAREWQPGADVAASFKAADCWTILV

SEQ ID NO: 14055 - protein, 424 aa, Brucella melitensis 16M
MSLFSPLVLNNGATIPNRIAKAAMEENMADADHAPSAGLLRLYKAWAEGETGLIITGNVMVDARAMTGPGGVVLEDDRHLDRFQAWAEAGRTRGAHIWMQINHPGRQMPAALGQETLAPSAIALDLGAQSKRFPIPREMSEADIADVERRFINTAQLAERADFTGVEIHAAHGYLLSQFLSPLSNRRQDRWGGSLENRARLLVNIVRGIRAAVSPGFCVAVKLNSADFQRGGFLPEDARAVVMMLAPLGVDLVELSGGSYEAPAMMGSARDERTLAREAYFLDFARDIAEIATMLLMVTGGIRRREVAEQVIESGIAMAGIATALAIEPNLPRNWRLGRADAPKLKPIAWKNKPLAASAHMAAVKYQLTRLSCQRRTAPGISPVWALAVSQIDAFFRARRYRQWMVDRRATPGRYRPDQFIRQS

SEQ ID NO: 14056 - protein, 412 aa, Brucella melitensis 16M
MGVCLLRSTRRTMRTINENTAAKTSRAPVRPEHNRIWILVFILSFLGLMIDGADLMLLSYSLTSIKAEFGLTSVEAGSLGSITLAGMAIGGIYGGWACDRFGRVKTVSWTIVLFSIGTAVLGLTHSYFQFAVARFVSSLGLGALYVACNTLMAEYVPTKYRTTALGTLQAGWSVGYIVATVLAGAILPVYGWRYLFFVAIVPVIIALLMHKGVPEPESWVRAKAERESGGSKFTTAKRESAFKAIFGNPRVRTLFIFWALTAGFLQFGYYGVNNWLPSYLETEMGMNFKSMTAYMIGSYTAMILSKVLAGVAADWLGRRAVFALGALGTAAFLPIIVLYHSPDTICGCWWCSASSMACLMASTRPIWLKASRPNIAVRLSAALTISVVRAQPLRRSPLASSQARSRSASASS

SEQ ID NO: 14057 - protein, 302 aa, Brucella melitensis 16M
MIMVSSDYSVCIVGLGSMGMGVAQSCIAAGLRTYGIDLDPAKCEAIIKAGAIGASSRCEAAGKLDALVLLVVNAAQCKAVLFGENGLAAQMKPGAAVMVSSTISAADAKEIAAALEAYNLLMLDAPVSGGAAKAASGDITVMASGSREAFEKLRPVLNAAAGKVYEIGQEIGLGATVKIIHQLLAGVHIAAGAEAMALAARSGIPLDIMYDVVTHAAGNSWMFENRMKHVVDGDYTPKSAVDIFVKDLRLVTETGLSMNFPLPLATTAYSLFANASNAGFGKEDDAAVIKTYAGIKLPDRSA

SEQ ID NO: 14058 - protein, 353 aa, Brucella melitensis 16M
MAFLNIKNLKKSFGTNTVVHDFNLAVEKGEFVSFLGPSGCGKTTVLRMIAGFETPDNGSIEIDGKDVVNLRPNQRNIGMVFQAYALFPNMTVAQNVSFGLRVSGKSRSEIDATVKEMLSLIRLDHLADRYPYQMSGGQQQRVALARALATKPQVLLLDEPLSALDAKIRISLREEIRAIQQKLGITTVFVTHDQEEALSISDRIVVMHEGRADQIGSPFDIYNRPASRFVASFVGTLNMLEASVSEPAQNSIDLDGRQITVQETLAHHPKGKPLTLALRPEAVSLEARKSHDTSLEATIDDVHFLGSVIRTRVILGKNRLSFDTFNDPTHPPPQRGDKVKVHFASHDLLVLAD

SEQ ID NO: 14059 - protein, 469 aa, Brucella melitensis 16M
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEADKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 14060 - protein, 322 aa, Escherichia coli
SKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 14061 - protein, 286 aa, Burkholderia cepacia
MDASEFSKFLKAALPAQAIAGAALTVAEVEIPGYAQDIVLRLYRRPDKTGLPVVLYFHGGGFVRGSLEDADFAARFLAERLPALVVSVDYSLAPAFPFPAAPEDAYRAAVWAATRARAFGGNPKKIGVAGHDAGGQLANCLAFIARDRGEVSIAAQALFGPMLDPSMTRIGDAERLASDITARECAACYRAYLPQAAQRMHPYAAPIESVRLAGLPPTLVVTAQNDVLHVEAENYAGCLISSGVLTQVIRYPDITHAALATHEAAFEEAVRFFQCRFQARQPNRPE

SEQ ID NO: 14062 - protein, 292 aa, Escherichia coli
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEKVAQAKSPHVAALGSEAGGTLYGLQVLERIEANQRQNFTRFVVLARKAINVSD

SEQ ID NO: 14063 - protein, 510 aa, Nicotiana tabacum
MALLDLQPSTSLLFCLVPLLFLFFIKFNKTITNTLLSSNSSKIPRSYPLIGSYFSILANHDQRIKWISDIILSTPNLTFTLIRPLNFHTIFTANPSNVQHMLKTNFQVYQKGHNSNTTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFILPFPLIWKMKRALNIGSEKKLRFAVEQVREFAKEIVREKQRELKDKSSLDSADLLSRFLSTGHSDENFVTDIVISFILAGRDTTSAALTWFFWLISKHPEVESQILKEIGEKSESLLLYDEVKNMIYTHASLCESMRFYPPVPMDTKEATKDDILPDGTFVKKGNRVTYHPYAMGRVEKVWGKDWAEFRPERWLDKDEVTGNWTFVSKDAYTYPVFQAGPRVCLGKEMAFLQMKRVVAGVLRRFKVVPVVEQGAEPVFISYLTAKMKEVFPVTIEERI

SEQ ID NO: 14064 - protein, 512 aa, Vicia sativa
MELETLVAWLLFSATLLWLLLLATKTQSKSLKSPSSTTNSTIPKSYPIFGSIFSIAANFHRRVQWISDILQTTPSSTFILHRAFGSRQVFTANPLVVQHILKTNFPCYPKGLTLNRSLGDFLGNGIFNADGETWKLQRQISSHEFNAKSLRKFVETVVDVELSGRLLPILSEASKTEKILPDFQDILQRFTFDNICIIAFGFDPEYLLPSLPETAFAKAFDYGTRISSLRFNAAVPLIWKVKKILNIGTEQRLKEAVAEVRGLASRIVREKKQELLEKSALESLDILSRFLSSGHSDESFVIDIVISFILAGRDTTSAALTWFFWLLSKHSHVETEILKEVTAKSESVSYDEVKDMVYTHAALCESMRLYPPVPVDTKEVAYDDVLPDGTFVKKGWRVAYHIYAMGRSEKIWGSDWAEFRPERWLRRDEDGMWSFVGMDPYAYPVFQAGPRVCLGKEMAFLQMKRVAAGVLREFRVVPAMENGIEPEYTAHLTALMKGGFPVRIEKRSHTDE

SEQ ID NO: 14065 - protein, 511 aa, Nicotiana tabacum
MALLDLQLSTSLLFCLVPLLFLFFVKFKKTITNTLLSSNNSSKIPRSYPLIGSYFSILANHDRRIKWISDIILTTPNLTFTLIRPLNFRTIFTANPSNVQHVLKTNFQVYQKGHGSYSTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFIVPFSLIWKIKRALNIGSEKKLRVAVEQVREFAKEIVREKQKELNDKSSLDSADLLSRFLSTGHSDEDFVTDIVISFILAGRDTTSAALTWFFWLISKHPEVESQIMKEVGEKSESLLLYDEVKNMMYTHASLCESMRFYPPVPMDSKEATKDDILPDGTFVKKGTRVTYHPYAMGRVEKVWGEDWAEFKPERWLDKDEVTGNWTFVPKDAYTYPVFQAGPRICLGKEMAFLQMKRVVAGVLRRFKVVPVVEQGVEPVFISYLTAKMKGGFPVTIEERI

SEQ ID NO: 14066 - protein, 344 aa, Escherichia coli
TPDCYQAADWRHRGYHAVELPGGDDYPQSRSGAGSRLHHGAEARQSDAVLCLALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 14067 - protein, 468 aa, Gunnera chilensis
  misc_feature (405)..(405): Xaa can be any naturally occurring amino acid
  misc_feature (440)..(440): Xaa can be any naturally occurring amino acid
KAGVGFKAGVKDYKLTYYTPDYETKDTDILAAFRMTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWXNAPGAVANRVALEACVQARNEGRDLAREGNEIIRXASKWSPELAAACEVWKEIKFEFEAMDTL

SEQ ID NO: 14068 - protein, 468 aa, Gunnera magellanica
  misc_feature (405)..(405): Xaa can be any naturally occurring amino acid
KAGVGFKAGVKDYKLTYYTPDYETKDTDILAAFRMTPQPGVPPEEAGAAVAAESSTGTWTTVWTDGLTNLDRYKGRCYGIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWXNAPGAVANRVALEACVQARNEGRDLAREGNEIIREASKWSPELAAACEVWKEIKFEFEAMDTL

SEQ ID NO: 14069 - protein, 466 aa, Gunnera perpensa
  misc_feature (153)..(153): Xaa can be any naturally occurring amino acid
  misc_feature (403)..(403): Xaa can be any naturally occurring amino acid
  misc_feature (440)..(440): Xaa can be any naturally occurring amino acid
GVGFKAGVKDYKLTYYTPDYETKDTDILAAFRMTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYVKTFQGPPHGIQVERDKXNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWXNAPGAVANRVALEACVQARNEGRDLAREGNEIIREAXKWSPELAAACEVWKEIKFEFEAMDTL

SEQ ID NO: 14070 - protein, 176 aa, Hevea brasiliensis
MASQSEPKSVYDFTVKDARGNDVDLSTYKGKVLLIVNVASQCGLTNSNYTELTQLYQKYKDQGLEILAFPCNQFGSQEPGTNEQIVEFACTRFKAEYPIFDKVDVNGNNAAPLYKFLKSSKGGIFGDNIKWNFSKFLVDKDGNVVDRYAPTTVPSQHREGCEETAGDCMSAQGRPN

SEQ ID NO: 14071 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVIHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 14072 - protein, 374 aa, Pseudomonas syringae pv. glycinea
MLKPHGLTPLALTGGILVSLLSVSLSAHADIATDIATTGWATQNGGTKGGSRAAANNIYTVKKRRRAESRTGCVGRQQRPDHQGDRVVIDVSEDKPYTKTSDIKQRARLDIPGKTTIVGTSSSAEIREGFFYAKENDVIIRNLTIENPWDPEDGNAGNWNSEYDGLTVEGASNVWIDHVTFTDGRRTDDQNGTANGRPKQHHDGALDVKNGANYVTISYSVFRNHEKNNLIGSSDSKTTDDGKLKVTIHNSLFENISSRGPRVRFGQVHLYNNYHTGSTSHKVYPFVYAQGVGKGSKIFSERNVLDISGISGCSKVAADYGGSVYRDSGSLVNGSVISCSWSTSIGWTPPYSYTPLAADKVAADVKAKAGAGKI

SEQ ID NO: 14073 - protein, 505 aa, Cochliobolus carbonum
MRTPGYIPSNGPANNIVQEYLSPDDAYPASFQDFKAMTDAEKIEVIAREAEEHGLERPKGWNVSFHYNPHVEYHHFGSSHPMKPWRLTLTKQLVLAYGLEYTMDLFEPRPANFNELAIFHDREYLSYLSKITPQNAQPDDPQYITYGFGGESNDCPVFDGLWNYVSLYTGATCSATWNLLNSRSDIAINWSGGLHHAKKNLASGFCYVNDIVIAIQLLLSHHQRVLYIDIDVHHGDGVEQAFESTDRVFTLSYHKYGIDKHGYPFFPGTGNIDETGPTDARNPGKAHSLNIPIDDGIDDEQYKWLFKTVTSAVIEKYNPTAIVLQSGADSLGGDRLGRFNLNIKAHGFCVETVKAYGRPLLIIGGGGYTPRNVARTWCHETSVCVGAQLHNELPAHVPYLQAFQGAENGDGVLYPDLHNIKRHENLNSQAKLHKLIEQALENLRYLEGAPSVTVDTRGISLEEIMKVREMIDQELEDEAEDRARLTVENSRRKKERNVGGRNERR

SEQ ID NO: 14074 - protein, 464 aa, Aeschynomene indica
GFKAGVKDYKLTYYTPDYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFPAMDTL

SEQ ID NO: 14075 - protein, 464 aa, Carmichaelia sp. JJD-2001
  misc_feature (312)..(312): Xaa can be any naturally occurring amino acid
GFKAGVKDYKLTYYTPDYETKDTDILAAFRVTAQPGVPAEEAGAAVAAESSTGTWTTVWTDGLTSLDRYKGRCYHIEPVPGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAIFARELGVPIVMHDYLTGGFTANTTLAHYCRDNGLLLHIHRAMHAVIDRQKNHGMHFRVLAKALRMSGXDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEIWKEIKFEFPAMDTI

SEQ ID NO: 14076 - protein, 464 aa, Cicer arietinum
GFKAGVKDYRLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMLKRAIFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDYIEKDRSRGIFFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTI

SEQ ID NO: 14077 - protein, 464 aa, Millettia richardiana
GFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPNSYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14078 - protein, 463 aa, Neorautanenia mitis
FKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHVHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 14079 - protein, 464 aa, Ophrestia hedysaroides
GFKAGVKDYKLTYYTPEYETKDTDILAAFRVTPQPGVPPEEAGAAVAAESSTGTWTTVWTDGLTSLDRYKGRCYHIEPVAGEDNQYIAYVAYPLDLFEEGSVTNMFTSIVGNVFGFKALRALRLEDLRIPKSYIKTFEGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14080 - protein, 465 aa, Oxyrhynchus volubilis
GFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHVHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTLD

SEQ ID NO: 14081 - protein, 463 aa, Peltogyne confertiflora
FKAGVKDYKLTYYTPDYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 14082 - protein, 465 aa, Zenia insignis
VGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 14083 - protein, 466 aa, Calopogonium caeruleum
SVGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 14084 - protein, 464 aa, Xeroderris stuhlmannii
GFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLARDGNEIIREASKWSPELAAACEVWKEIKFEFPAMDTL

SEQ ID NO: 14085 - protein, 167 aa, Blumeria graminis
MGPTTTLYDFMPKDKNGEPVPLEKYKGQVVLIVNTASKCGFTPQFEGLEKLYKSVSSTHPGKFTILGFPCNQFGGHDPGSNDEIQNFCRINYGVTFPMLGKVNVNGDTADPLFEWLKVEKPGIMGMKRVKWNFEKWLVSKDGKPIKRYSSTAGPEGFQSLIIEEIEK

SEQ ID NO: 14086 - protein, 451 aa, Citrobacter braakii
MSKLQHHSIGEVEPSIAIVGSGPAGCYTAQTLHKQWPSAQIVIFERLPVPYGLLRYGVSPDHQGTKAIARQFDRLFAEASVHFIGNVEVGKHISVEELQDAFDVVVLAAGLGADRPLPSLAGDAVYGAGQVMRWFNSHPDEQSFAPGFGATTTIIGNGNVAMDVVRLLAKHRDSFTGSDLDPQLIEKQPSRIHVVGRSPASAAKFDSMMIRELAEIDDAVFDVDVVDEPGHEDKRIHAKTKALLDLTAARAVPSPRVHVSFHFGWTPESLEPTGDGRTLRLVNTESRLAVKLIETDSVITAVGFGSGLRHEIDRVRFESAASDLDNGLLDTGLYCSGWFRRGPTGGIPANRLDAKMVCTRIIEDVASGAITPKKRGLEELATHLHPDTVDFTGWQRIDAVEASRTEHGRCRTKLPDIATMLDFARNRTHERTTDDTYRKQITDTVGHKEKR

SEQ ID NO: 14087 - protein, 198 aa, Escherichia coli
EKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVYGFWCTGTERHY

SEQ ID NO: 14088 - protein, 511 aa, Escherichia coli
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 14089 - protein, 509 aa, Medicago sativa
MTMAGPGQLNVIESPSRGSRSVDCFEKLEQIGEGTYGMVYMAREIETGEIVALKKIRMDNEREGFPITAIREIKILKKLHHENVIKLKEIVTSPGPEKDDQGRPDGNKYKGGIYMVFEYMDHDLTGLADRPGMRFTVPQIKCYMRQLLTGLHYCHVNQVLHRDIKGSNLLIDNEGNLKLADFGLARSFSNEHNANLTNRVITLWYRPPELLLGTTRYGPAVDMWSVGCIFAELLHGKPIFPGKDEPEQLNKIFELCGAPDEVNWPGVTKTPWYNQFKPSRPMKRRLREVFRHFDRHALELLEKMLTLDPAQRIPAKDALDAEYFWTDPLPCDPKSLPKYESSHEFQTKKKRQQQRQNEENAKRLKMQNPQQHTRLPPIQQGGHAQMRQGPNHLIHGSQPAGAAGPSHHYGKPRGPSGGPGRYPPGGNPSGGYNHPNRGGQGGGAGYGSGPYPPQGRGAPYGSSGMPAGTGGGPRGGGGFGAPNYPQGGPPYGGSAAGRGNRNQQYGWQQ

SEQ ID NO: 14090 - protein, 48 aa, Antirrhinum majus
AVYVGENEKKRFVIPLSHLNERLFQDVLCRADEEFGFHHPMGGLTIPC

SEQ ID NO: 14091 - protein, 1043 aa, Vibrio vulnificus
MFTATDVLKPEFVAQPLDKLWALISPLYMVDESQWLEQLLPLATPSAEEKQAIASRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRIASREGLGVFVCISPWNFPLAIFLGQVTAALVAGNTVVAKPAEQTSLIAVRAVELMLQAGFPASVVQLIPGRGADIGSALTSHPSIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPYLHKTDVGPVIDARAKEKLLQHIEQMNQTQKPIAQLTLADDCQHGDFVTPTAFEISGIDVLKEEQFGPILHIVRFKASELTRVVEHINQTGFGLTMGIHSRNETTYRWIEKHARVGNCYINRDQVGAVVGVQPFGGQGLSGTGPKAGGPHYLYRFTQVQFNQTENA

SEQ ID NO: 14092 - protein, 1452 aa, Aspergillus fumigatus
MNESHEAGKNSSTNVEEREEEVLRLARQFTEQSSYSTAGQTPFAAEAGSALDPNGERFNARAWCKAMLQMHIGDKEAHPLRTLGVAFSNLNVHGFGSDTDYQKSVGNVWLKTLSLARIAFGQKQRKVDILQNLEGLVEAGEMLVVLGPPGSGCSTFLKTIAGETYGFHVDKNSNINFQGIAKQMAHEFRGEAIYTAEVDVHFPKLTVGDTLYFAARARTPRHIPGGVNATQYAGHMRDVIMAMFGISHTKNTIVGNDFIRGVSGGERKRVSIAEACLSNAPLQCWDNSTRGLDSANAIEFCKTLRMQADINGTTACVSLYQAPQAAYDYFDKVLVLYEGREIYFGPTSMAKHYFLQMGFVCPDRQTDADFLTSMTSHLERVVQPGYEDRVPRTPDEFAARWKASPQRAQLMQHIKSYNAKFALDGEYLDKFKQSRRAQQAKAQRVSSPYTLSYVQQVKLCLWRGYQRLKADPSVTISSLFGNTIISLVIASIFYNLKADTSTFFQRGALLFFAVLMNALGCGLEMLTLYAQRGIIEKHSRYALYHPSAEAFSSMIMDLPYKILNAITSNIVLYFMTNLRRAPGAFFFFVFTSFILTLTMSMFFRSMASLSRSLVQVLPFSAVLLLGLSMYTGFAIPTGYMLGWARWIAYINPISYGFESLMINEFHNRDFPCMDYVPSGPGYTDVGLNNRVCSTVRSVPGQAFVNGNAYIESAYSYTASHKWRNIGVIFAYMFLLGAVYLVATDFITEKKPKGEILVFPRGHKALKKGKSDEDLEGGGGRSATVEKIGSDGLAMIERQTAIFQWKDVCFDIKIGKENCRILDHVDGWVKPGILTALMGVSGAGKTTLLDVLATRTTMGIISGEMLVDGQPRDESFQRKTGYAQQQDLHLSTATVREALEFSALLRQSAHVPRQEKIDYVTEVIKLLDMTEYADAVIGVPGEGLNVEQRKRLTIGVELAARPQLLLFLDEPTSGLDSQTSWAILDLLDKLKKNGQAILCTIHQPSAMLFQRFDRLLFLQAGGRTVYFGEIGQNSQILIDYFVRNGAPPCPPDANPAEWMLDVIGAAPGSHTSINWFETWRRSPEYARVQEHLAELKHERRHQTNLFRTTSGQKREDKDSYREFAAPFWAQLYQVQVRVFQQIWRSPTYINSKTALCVLSALFVGFSLFHTPNTIQGLQNQMFGIFMLLTLFGQLIQQIMPHFVAQRALYEVRDRPAKTYSWKAFLIANIVVELPWNSLMSVLMFLCWYYPIGLYRNAEPTDAVHLRGTQMWLMIWTFLLFSSTFAHFMIAAFDAAENAGNLGNLLFLLCLLFCGVLATPDQLPRFWIFMYRVSPFTYLVSGMLSVGISNTNVTCADNEYLRFDPVNGTCGEYMGSYMSNLGGYLADEMATANCSFCPIKETNVFLGRVSSSYSDIWRNFGLMWVFIVFNIFAACSLYWWVRVPRDKKPVAKAE

SEQ ID NO: 14093 - protein, 246 aa, Helianthus praecox
ANYGGDKQYGRETRQTGDYDNPIHSTGGQYEQDVRQTDEYGNPVRRTDEYGNPVHSTTGGTMGDYGSTGLGRGTAGIGTGGYGTTGHQGLGTGVGHTTGGIGTDYISGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQHQSQTTTTTTAGGAGYGETHEKKGMMEKIKEKLPGHH

SEQ ID NO: 14094 - protein, 246 aa, Helianthus praecox
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGIGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 14095 - protein, 476 aa, Clarkia delicata
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKLLGIYEHRVAVQG

SEQ ID NO: 14096 - protein, 127 aa, Clarkia delicata
KGEVVNNHDELMSNFFAQPDALAYGKTPEQLKKENVSEHLIPHKLLGIYEHRVAVQGFVWGINSFDQWGVELGKSLATQVRKQLHASRVKGEPVEEGFNFSTKTLLTRYLQATSDVPADPSTLLPNI

SEQ ID NO: 14097 - protein, 170 aa, Mesembryanthemum crystallinum
MASQSTDQPKSIHDFIVKDARGNDVDLSIYKGKVLLIVNVASQCGLTNSNYPELTKLYEQYKDKGLEILAFPCNQFGNQEPGDNEQIMEFACTRFKAEFPIFDKVDVNGSNAAPVYKYLKSSKGGLFGDGIKWNFTKFLVDRDGKVVDRYAPTTSPASIEKDIKKLIGTS

SEQ ID NO: 14098 - protein, 466 aa, Escallonia pulverulenta
  misc_feature (380)..(380): Xaa can be any naturally occurring amino acid
SVGFKAGVKDYKLTYYTPDYETKETDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPXLTEIFGDDSVLQFGGGTLGHPWGNAPGAVANRVALEACVQARNEGRDLAREGNEIIREACKWSPELAAACEVWKEIKFEFEAMDTL

SEQ ID NO: 14099 - protein, 165 aa, Ricinus communis
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 14100 - protein, 244 aa, Tithonia rotundifolia
ANYGGDKQYGRETRHTGDYGNPIHSATGGQYDQEIRQTDEYGNPVRRTDEYGNPVHSATGGTMGDYGSTGLGQGTGGIGTGGYGTTGHQGLRTGLGHTTGGTDYTSGGRSTEQTGYQGLGTESAFGGTTGTFQNQPSATPVGGVGLSTGTGAGFRGTGIGTGVLHRSGSGSSSSSEDDGQGGRRKKKGVMQKIKEKLPGGHSQEEQYQSQTTTTAGGVGRAGYGETHEMKGMMEKIKEKLPGHH

SEQ ID NO: 14101 - protein, 466 aa, Pentaphragma ellipticum
SVGFKAGVKDYKLTYYTPDYETKDTDILAAFRVTPQPGVPPEEAGAAVAAESSTGTWTTVWTDGLTSLDRYKGRCYHIEPVPGEENQYIAYVAYPLDLFEEGSVTNMFTSIVGNVFGFKALRALRLEDLRVPTAYIKTFQGPPHGIQVERDKLNKYGRPLLGCTIKPKLGLSAKNYGRAVYECLRGGLDFTKDDENVNSQPFMRWRDRFVFCAEALNKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDAVLQFGGGTLGHPWGNAPGAVANRVALEACVQARNEGRDLAREGNEIIREASKWSPELAAACEVWKEIKFEFQAMDTL

SEQ ID NO: 14102 - protein, 466 aa, Platyspermation crassifolium
SVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 14103 - protein, 171 aa, Sporobolus stapfianus
MASASKEEVIGKLNVRVVRGSNLAICDPLTHTSDPYVVLHYGAQKVKTSVQKKNPNPVWNEVLQLSVTNPTKPVHLEVFDEDKFTADDSMGVAEINLTDIYDAAKLDLKHAADGTRIKTIYPVGVNYLGGESHVMWKDGKVVQDLILKLTKTDSGLITLQLEWVHVPGVKL

SEQ ID NO: 14104 - protein, 370 aa, Brucella melitensis biovar Abortus
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKMRANAFAAALTRRPPDTGSTCFKPARRSCRWCSSPATAMPRLARVFARRR

SEQ ID NO: 14105 - protein, 320 aa, Lycopersicon esculentum
MGSKYSKATNSINDASNLSYGIPFENYRVPFVDLEEATNNFDDKFFIGEGGFGKVYRGVLRDGTKVALKKHKRESSQGIEEFETEIEILSFCSHPHLVSLIGFCDERNEMILIYDYMENGNLKSHLYGSDLPTMSMSWEQRLEICIGAARGLHYLHTNGVIHRDVKCTNILLDENFVPKITDFGISKTMPELDLTHLSTVVRGNIGYIAPEYALWGQLTEKSDVYSFGVVLFEVLCARPALYLSEMMSSDDETQKMGQLEQIVDPAIAAKIRPESLRMFGETAMKCLAPSSKNRPSMGDVLWKLEYALCLQEPTIQDDPE

SEQ ID NO: 14106 - protein, 194 aa, Oryza sativa (indica cultivar-group)
MAAPDVEYRCFVGGLAWATDDRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREAATAVAVATVAAVVAAATVVATAAAAAATPTGTGGTERWGPHGQVIYLSNRATIIIIRSLSSLVLCGTI

SEQ ID NO: 14107 - protein, 461 aa, Listeria monocytogenes
MSLFSLKRKNHFVPLEIQRQQWFKHFIVAFMSVFICYLTVYLLRNNFKAAQTLLIEQNHFSTTELGMIGLAFSVMYGIGKTILGYVVDGRNAKKIMSFLLGISAIISIIIGILLVAKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 14108 - protein, 179 aa, Bacillus firmus
MRDEIKEVLISEEEIQEKVKELGKAITEEYDGRFPLVVGVLKGAMPFMGDLTKRIDTHLEMDFMDVSSYGAGMVSSGEVKILKDLDTSVEGRDVLILEDIIDSGLTLSYLIKLFHYRKAKSVKVVTLLDKPDGRKVDLVPDMAGFTVPDAFVVGYGLDYAERYRNLPYIGVLKPEIYES

SEQ ID NO: 14109 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFFNDLERCERITKALEVGAVWVNCSQPCFVQAPWGGIKRSGFGRELGEWGIQNYLNIKQVTQDISDEPWGWYKSP

SEQ ID NO: 14110 - protein, 385 aa, Lycopersicon esculentum
MANEEAEKKKNTSSSEAKQPLKTAKKKTLGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNARMAPVHVLINNAGIFSIGEPQKFSKDGYEEHMQVNHLAPAMLSILLLPSLIRGSPSRIVNVNSTMHYVGFVDPEDMNVVSGKRKYTSVVGYGGSKLAQIMFSSILHKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 14111 - protein, 385 aa, Solanum bulbocastanum
MANEEAEKKKNTTSSEAKQPLKTAKKKALGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNSRMAPVHVLINNAGIFSIGEPQKFSKDGYEEHMQVNHLAPAMLSILLLPSLIRGSPSRIINVNSTMHYVGFVDPEDMNVVSGKRKYTSVVGYGGSKLAQIMFSSVLQKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 14112 - protein, 318 aa, Betula pendula
MATFPVIDMEKLNGEERGATMELIEDACENWGFFELVNHGISHDLLDTVEKLNKEHYRKCMEERFKDMVASKGLEAAQSEVRDMDWESTFFLRHLPASNMSEIPDLDEDYRKAMKEFAGNLEKLAEQLLDLLCENLGLEKGYLKKSFYGSKGPNFGTKVSNYPPCPKPELIQGLRAHTDAGGLILLFQDDKVSGLQLLKDGKWVDVPPMRHSIVINLGDQLEVITNGKYKSVLHRVLAQPDGNRMSLASFYNPGSDALIYPAPVLVEKEAEKGQVYPKFVFEDYMKLYAGLKFQAKEPRFEAMKAMESTVKLGPIATA

SEQ ID NO: 14113 - protein, 468 aa, Polyspora longicarpa
KASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHSGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14114 - protein, 454 aa, Rhodobacter capsulatus
MAEFDVIIIGGGPGGYVCAIRCAQLGLKTACVEGRGALGGTCLNVGCIPSKALLHATHELHEVHENFEKMGLMGAKVKVDWAKIDGNTKGIEFLFKKNKVTYLRGWGSIPAPGQVKVGDEVHTAKNIVIATGSESSGLPGIEIDEQTVVTSTGALSLAKVPKSMVVIGAGVIGLELGSVYARLGAEVTVVEYLDAITPGMDAEVAKGLQRILTRQGLKFVLGAAVQGVDKAKGKNTVRYTLRKDESAHAIEAEVVLVATGRKPFTKGLGLEALGVEMLPRGQVKADSHWATNVPGLYAIGDAIVGPMLAHKAEDEGMAVAEVIAGKHGHVNYDVIPGVIYTTPEVAAVGKTEDALKQEGRAYKVGKFSFMGNGRAKAVFQAEGFVKILADAATDRILGAHIIGPSAGDMIHEICVAMEFGASAQDLALTCHAHPTYSEAVREAALACGDGAIHA

SEQ ID NO: 14115 - protein, 275 aa, Wolbachia endosymbiont of Onchocerca volvulus
MSLIKLSPTIAVTDKVNRLKSQGKEICVLAAGEPDFDTPGHIKKAAIQAINEGKTKYTAVDGTRELKGAIIDKLKRDNDLEYMPSQICVSAGAKQVLFNLLMATINPEDEAVIPAPCWVSYVDMVSFFGGLPVIAECKDNFKLTSELLRSKITEKTKWLILNSPNNPAGVVYTYDELKKIAQILLEYPHVNIITDDIYEHIVYDGKFFTIAQVEPRLYDRVFVVNGVSKAYAMAGWRIGYVAGRSDVVKAISILQSQSTSNPNSIAQAAAVEALN

SEQ ID NO: 14116 - protein, 377 aa, Wolbachia endosymbiont of Brugia malayi
MSDLAKRMSLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYDELKAIAQVLLEYPHVNIITDDIYEHIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATS

SEQ ID NO: 14117 - protein, 372 aa, Chlamydomonas reinhardtii [sequence omitted]

SEQ ID NO: 14118 - protein, 301 aa, Clostridium perfringens str. 13
MLRILLNDGLDKKAISNLEFLGFDVDTNHYDIEDLKEKIKKVDCIVIRSATKIRRELIDEAIKGGKLKLIIRGGVGVDNIDVQYAEQNGIKVRNTPNASSSSVAEIILAHMFSLARFLNQSNITMKAGLWKKKDYVGVELEGKTLGIIGMGRIGSELAKKCTALGMKIIYFDLMDIKNIDNNYRKVEFDELLRESDFISINISGTKSIIGSEELKKVKKGVFIINTSRGKALDEEAIITSLNDGTLGGVGLDVFLEEPSKNLELINHPKVSLTPHIGASTKEAQMKIGEEVINIIKEEMYN

SEQ ID NO: 14119 - protein, 440 aa, Clostridium perfringens str. 13
MGKPKLKKEIGLFTATALVVGNMMGSGIFMLPASLASVSGPGSTIMAWLLTGLGSLVLALTFANLGSKIPKTGGTYEYSRLAYGNFMGFMTAWLYWNGSWIGNATIFIVITTYLGEVITSLTNSPIIGFLFCSSILWICTYINIRGTKLAGRVASVITVFKVLLFIFFIVVGLIYFDPSNLTPMFPDGKGVSTIPVAASLTLWAFMGLETASVAGGEIKDPEKNVKRSTILGMLISTVLYILISVVAMGAMSQSELASSTAPISDIIVKVLNLKSLNFLNIAIAISILGTAMGWLLSTARVGYAAGEDGIFPSVFAKVHPKYNTPHVALIIGSIFINIIFLMNFTKGLAGAYSFIVVLATLSYLPIYAISTIAEIILMVKEEKKPTFKKHLGLIIRCLIGFAFAIWAIYASGAEIVMYGFILILLGVPIYGYMSIKKHFR

SEQ ID NO: 14120 - protein, 338 aa, Clostridium perfringens str. 13
MRYIEFDEKRKFDIVPVGRVAIDFNPTDIHKPLSESRNFNKYLGGSPANIAVGLARLGKKVGFIGKVSDDRFGEFVVNYFKKEGIDVSEISKAKNGESLGLTFTEILSPTESSILMYRNGIADLQLDVDDIDEDYIKNTKAIVISGTALAMSPSREAALKALRLAKKNGTVVIFDVDYREYNWKNKDEIAIYYSIVGKESDIIMGSREEFDLMEGLIAKDSTDEETAKRWLDYGNKIVVIKHGKDGSTAYTRDGKAYRIKPFPVKLLKSFGGGDAYASAFIYGILEGWDMMDALEFGSASAAMLVASHSCSEDMPTVEAIKEFIKKEKEEYGEMVARS

SEQ ID NO: 14121 - protein, 302 aa, Clostridium perfringens str. 13
MKYYNDIRDLIGNTPILKLNNISTKEGVNIYAKIEGTSPGGSCKDRVGIYMVEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGEIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEKGNIVTIFPDRGDRYFSTDLF

SEQ ID NO: 14122 - protein, 445 aa, Clostridium perfringens str. 13
MFGFFSPAPAIPRLPKDKVSSAYKAYRIRMFLMIFIGYTGYYLVRKNFAVASPYLIDNYGFSKTQIGLISMGLAVSYGLSKFILGNLSDKSNVKKFICFGLIASSVLSVLMGFARTVPIFLILMVFNGFFQGMGAPPCSIVLGKWFSQKERGLKMGIWNTSHNIGGGLIAPIATLCLLVFGQNHFQSIFFVPAIICTIVALFCYVIGADTPASVGLPPVEEYRNDYPEVKAEVNPTTLSSKEIMVKYVLKNKYVWYLALANIFVYLIRQGVVNWIPIYLKESKGFSAANANWAMFLFEYAAIPASILLGWLSDVVFKGKRAPLSILCMIGVIFATVAYWQTSSTLVTMISVAFIGCFIYGPQLLIGMNLIDVVPNFAVGSATGFSGLCGYLLGEFMADFVLGMIADSFGWNGAFIFIIVGAFIALLLLALTLKIKKNPQVEDKIA

SEQ ID NO: 14123 - protein, 499 aa, Clostridium perfringens str. 13
MEICSSNSIRNMDKDYIEKFNMPSIVLMENAIIKFLENIDLTKESFTIISGRGNNGGDALGIARHLLNKGKKVYVHILEKEKEGSVDYKTNLTILEKLGCYIKGISNSKDLEILKNNIINSEILIDGILGTGLNKEISGIYFNTIKCINENSKFTVSIDVPSGINSNDGSICGIAVKANETISFQVYKLGFLNYKSFEYLGNLKIVDIGIPKSIVYKNSDNMRFTDREYIRNKFPYRNKYGHKGTYGRSLIFAGHKGFIGAAYMVGQAAIKTGAGLVTVFTHKDVQSELSIKLNEGMTGTYNSKEEYEEFISGANVIAFGPGMGNNDLTFEVLNNIFNLYSGTLVIDADGINVLERKKSILKEFKGDIVLTPHPGEMARLLGIEIKDVERDRIGIAKDFAKQNGITVLLKGYNTIITDGDKVFVNPTGNSAMASGGMGDTLTGIITSLISQGVNSFDAAILGAYIHGYIGDELSKENFTVSAMEIIKNIPNKIKELISF

SEQ ID NO: 14124 - protein, 460 aa, Clostridium perfringens str. 13
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGAYLLSLLDILGIKLPKTFTAIPSEGGIVNLPAMISILFIVFVISLGTKESKKVNDIMVFIKIVVIALFIGVGAFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEETWKIFIVVLVLLITSYLVYGRKHSLINKNNDN

SEQ ID NO: 14125 - protein, 467 aa, Clostridium perfringens str. 13
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 14126 - protein, 287 aa, Clostridium perfringens str. 13
MKKIGFIGVGIMGKSMVRNLMKNDFEVSIFARNKDKVLDVISEGANFYPTIKECVSGCDAVITIVGFPKDVEEVYFGENGILENVKEGTYVIDMTTSSPKLAVEIFEKAKEKGVKALDAPVTGGDIGAKNGTLTILVGGEEEDYKACLPILKAMGTNIHYEGKAGFGQHTKLANQIMIAGAISGVCEAMAYAKDKGLDVKKMLDSVSTGAAGSKQLELVSPKILEEDFAPGFFIKHFIKDMKLAKEEALAYNVNLDILSKVLENYEELEREGFGDLGTQALIKHYNK

SEQ ID NO: 14127 - protein, 348 aa, Clostridium perfringens str. 13
MLCALIMAGGKGTRFWPLSTEEKPKQFLNLIGDKTMIQMTIDRVKPIIPIERIFVCTGEKYIDLVKEQLPELPENNIIVEPEGRNTAPCIALSALVIKRYYKDATMVVLPSDHLISNEDRFRNILLDGEEYLKENGKSILTLGMTPNRAETGYGYIKFTEDKSLVNNSEVIKVEKFVEKPNKERAEEYLKDGSYLWNGGMFLWTIDNIINRIKEHIPNTYESLKEIEEVKEEKLQELINNNYKKTDSISVDYAILENADEIRVIPSDIGWDDIGTWRSVERYREKDINNNIIDENVRVIESKSNMAINKEKRVVMIGIEDIMTVETEDTIFIVKKDYMDNLRDYKEVL

SEQ ID NO: 14128 - protein, 285 aa, Clostridium perfringens str. 13
MLMNRNVSTFIGCEAEYDESSIVVFGAPFDSTTSFRPGTRFASQVMRGESWGLESYSPYQDLDLYDFNIFDGGEIELPFGNSEGALALIEDFSTKVVEDGKIPAMIGGEHLVTLGAFKGVFKKYPDVHVIHFDAHADLREDYLGQKLSHATVIHRVWDLVGDNKIFQFGIRSGEKEEFLWAKDHVYTNKFNCDTLDYALERVKDKPVYVTIDLDVLDPSVFPGTGTPEPGGIQFNELLNSILKLRGLNIVGFDINELSPQYDQTGASTAVACKVLREMLLVANNK

SEQ ID NO: 14129 - protein, 240 aa, Clostridium perfringens str. 13
MINVRNLYKSFGKNEVLKDINETIKKGEVVVIIGPSGSGKSTFLRCLNLLEEPTSGVINFEGEDITDKNVDINKIREKMGMVFQQFNLFPHKTVMENLTIGPTKIKNISNGDAVKKGSELLEKVGLLDKKNVYPNSLSGGQKQRIAIARALAMEPDVMLFDEPTSALDPEMVGEVLGVMKSLAKDGMTMVVVTHEMGFAKEVGDRILFMDEGRIIEEGTPEEIFQNPKNSRTKDFLSKVL

SEQ ID NO: 14130 - protein, 474 aa, Clostridium perfringens str. 13
MYIDFYKNIFLVRGLIMIITRDKRFYRLLFSIALPIAVQNLITFMVSMVDTLMVGDLGEIQLSAVSIANNLFFVLTILMFGLAGGSNIMISQYWGKGNVKTIHKILAIMYRVCLLITGIFIFIALFLPKYFMGIFTTDKAVIDFGASYLRIVCIGYLFYSITNCTIMMLRSVKTVSISIIVYTASLVVNSILNWIFIFGNLGAPELGIRGAAIATVCARITEFSIVLVFMFIYERKIGLKIEHLLKLDKEILKDYVGLCTPVLCNELLWAIGASMISVIVGRMGTEVVAANSINGVAHQFVTVFIFGMSNATAVIIGNTIGEGKKEKAKEYAYSIGIFSVVMGCISGLMILLIKPFVVNFYNVSYSTKLIAMEIMTVTSGIIVFQSLASNFMMGVLRGGGDAKFVLINDLIFMWLVAIPGGFFVAFVLELPVALVFLVIKCDEILKSLTSVYRVISGKWVNDVTKDYEFEEVKC

SEQ ID NO: 14131 - protein, 158 aa, Clostridium perfringens str. 13
MEIYDISVKDINGENVSLERYRGKVLLIVNTASKCGFTKQFDGLEELYEKYKDEGFEVLGFPCNQFKEQDPGSNSEIMNFCKLNFGVTFPMFEKIDVNGENESLLYSYLKEQKSGMFGSKIKWNFTKFLVDREGNVIKRFSPQTTPKSIEKDIEELLA

SEQ ID NO: 14132 - protein, 234 aa, Clostridium perfringens str. 13
MASLLAELIGTMLLIILGDGVVANVVLKKTKGNSSGWIVITTGWALAVAIPAAIFTSVSGALFNPALTIALAIVGQFTWSQVIPYIIAQLLGAFLGAVVVYITYYNHFEETEDQNSKLGVFCTIPEIEDHKINFLTEFIGTFVLTFAVLGIGAQNIDYGVKVIIIGCLIWAIGLSLGGPTGYAINPARDFGPRLAHFLLPIPRKGSSKWEYAWIPIVAPIIGAICGALVYVNIF

SEQ ID NO: 14133 - protein, 178 aa, Clostridium perfringens str. 13
MLYDFKVKDIEGNEVSLGEYKGKVLLIVNTATGCGFTPQYEGLEVLYKKYHDKGFEILDFPCNQFFEQAPGSNEEIVGFCKLNYGTTFKTFAKVEVNGENACELYKFLKKEAPMAKEDETSLGFYDKLKGLGFTTEGEEIKWNFTKFLIDKNGEVVARFAPTFEPEKLDELIEELLEE

SEQ ID NO: 14134 - protein, 364 aa, Clostridium perfringens str. 13
MGEVMDIIGSINTRFLSKSEQSKKEIFNKIDNIVKGGGNIIRMNLSHGKHRDVECCIDYIRSNHKNVKILLDLQGNKIRVANNIYGTFKVNSGDLVYFCSEETYDAYLKNIDRNKLIPLNIKNKFIYNNTFKKIYMKDATMEFIVISNNNGLIKTKVKLGGVVRKEKGCNLPNLDRKNWGVSEKDLEDIKFAIDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKRV

SEQ ID NO: 14135 - protein, 235 aa, Clostridium perfringens str. 13
MCPNCGHHFKLGAYERIKYLTDENTFVEFDKKMIGRNPLDFNGYEEKIKGYQKKSHVIEGVVTGEAYIAQRKVVLCVMDSNFMMGSMGTAVGEKITRAIEYATKNRLPLIIFTCSGGARMQEGIYSLMQMAKVSGAIYRHGRENLLYITVLTNPTTGGVTASFAMEGDIILSEPGCLVGFAGRRVIEGTINEKLPDDFQTAEFLLEKGFIDKIVQRKDLKQVITSLLRMHEVDYE

SEQ ID NO: 14136 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 14137 - protein, 490 aa, Clostridium perfringens str. 13
MDYKFDVKNPRNLTMLVDFYELTMANGYFKNGIENKIAYFDMYFRRVPDGGGYCIMAGVEQLIEYLSNLNFSEDDIAYLRSKELFCDEFLDFLINFKFTCDVWAIPEGNPVFPNEPLVIVKGPVIQAQFVETMILLTINHQTLIATKANRICRAAKDKTVMEFGSRRAQGYDGAIYGARAAAIGGCDSTACTIADQMFDIPAIGTMAHSWIQLFGDEYEAFKAWAVAYPDNCTLLIDTYNVLKSGVPNAIKVFDEVLKPLGKRPKGIRIDSGDITYLSKKCRQMLDEAGYPDCKIIVSNSLDEYIIRDVLSQGASIDAFGVGERLITARSEPVFGGVYKLVAVEDEEGNIIPRIKISENEEKITNPGFKRIIRIFDNNTHTALADLILLNDEEIDTNKPLEIFDPIHVWKRKTLTNYYVKDLLVKIFEDGKVCYKNPTVMEIRDYAQKECEKLWPEILRFENPHTYYVDLSNGLWNLKHNLLHRYSSIYK

SEQ ID NO: 14138 - protein, 468 aa, Clostridium perfringens str. 13
MSNLKKKRVKSREQDPIERGKNFKEVSLGYGEEEAIEEANRCLGCKNPKCVEGCPVSVNIPSFISFIKKGDFSASFEELSKYNALPAVCGRVCPQESQCEGKCVLGIKGEPLAIGQLERFIADFARNNKLSSLKKSEKILEKVAVIGSGPAGLTCAGELAKLGYRVTIFEALHESGGVLVYGIPEFRLPKKDVVKYEIEEIKKLGVKIENNVVVGKTVDIDELIENEGFKAVFIGSGAGLPKFMGIKGENANGVFSANEVLTRVNLMKAFKNESHTPLNLGKKVAVVGGGNVAMDAARTSLRLGAETHIIYRRSEKELPARLEEIHHAKEEGVILDVLTNPTEILTDEKGWVKGIKCIRMKLGEEDSSGRRRPIEIENSEFIMEVDSVIMSLGTSPNPLISNATKGLKTNKRGCLLVDEESLKTSLKGIYAGGDAVTGAATVILAMGAGKKAAKSIDSYLRKEEQNNI

SEQ ID NO: 14139 - protein, 343 aa, Clostridium perfringens str. 13
MDLINLQNINVSYDKKNNILENLNLKVKKGELVSLLGPSGCGKTTTLRVVAGFIEPTAGKFLLGDEDYTNIPVHNRNFGLVFQSYALFPHLTVEENVAFGLKMKKMSKEEIRKKVDDILKVVDMSHLAKRYPKELSGGQRQRVAIARALVIEPSLLLLDEPLSNLDAKLRLKMRVEIRKLQQKLGITTLFVTHDQEECFSISDKVAVLNKGVIEQFDTPENIYSNPATEFVARFVGFENFIDLIKVSDGIYKNESGINLKVNKVKDKNEVKATIRPDDIKIVKEDLENTVNGVIEVRTFLGKAYQYDIKTKLGNLIVNSENDSIYEKGQNIKLQLPVDKIVIL

SEQ ID NO: 14140 - protein, 300 aa, Clostridium perfringens str. 13
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTKGYFMPQQFLNEANAKKHYETTAEEIIRDIPDLDVFIAGVGTGGTITGVGRKLKEYNPNIKIVAVEPSDSAVLSGENSGPHKIQGIGAGFIPKIYDSSVVDEIIKVKNEDAYTMAKNFADKEGVLVGISSGAALKGAKDILENIAKDKKVLVIAPDGGEKYFSTGLYE

SEQ ID NO: 14141 - protein, 230 aa, Clostridium perfringens str. 13
MIEIKNLEKSFKGNKILENISFTLKEGEILTLLGPSGAGKTTIFRILNGLETCDFGDITLDSLKICENGIYKDSKAQKEIHKKIGLVFQTFNLFPHMNILENLILAPMHTLNLSLEEATKKALQILSRLSLEDKARSYPCELSGGQKQRVAISRALMLNPKYICFDEPTSALDPSLTKDVSNIIKSLAKENIGVLIITHDMEFAKEVSSRIIKLDSGKILEDIPSKEFWI

SEQ ID NO: 14142 - protein, 427 aa, Clostridium perfringens str. 13
MNMDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 14143 - protein, 315 aa, Clostridium perfringens str. 13
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELKDKKNLDLNSWREIISYGNKVGALTCTNYGAIDAIPNEEDLMKYI

SEQ ID NO: 14144 - protein, 429 aa, Clostridium perfringens str. 13
MEKFFKLKENNTDAKTEFIAGLTTFMTMAYILIVNPSILSAAGMDQGAVFTATALSAVIATLIMGLYAKLPFAQAPGMGLNAFFAYTIVIQMGYSFEFALTAVLLEGIIFILLTIFNVREAIVDSIPKGIKNAISVGIGLLIALIGLEGAGIVVHTDGGTIVSLGNIVSGSGLLAIIGLLITSVLIAKNVKGALFIGMIITAIIGIPMGITPMTSKIISMPPSIAPTFFKFDFHNIFSLDMVIALFTLLFMDMFDTIGTLVGVATKAKMLDKDGKVPNIKKALFSDAVGTTLGACLGTSTVSTFVESASGVAEGGRTGLTAVSTAFMFFLALFFAPLFAVITPAVTASALVLVGLFMIEPIKEIDLHDFTEAIPAFLTIIMMPFAYSISDGIVFGVISYIILKLFTGKRKEISLTTVILGLVFLLKFLI

SEQ ID NO: 14145 - protein, 1064 aa, Clostridium perfringens str. 13
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEEAVLSLENSLKGVTLENGFLKINEEVAPGTKIIVKAYDSLNDMTAYKEIEVREEGEKGTFVQFLKNDGLYYGENFSWNIWGFGENSSGKEFNLNIKTDLGVGTFVDEEKFIVRKRTWGCNWVNDWNEQTYTFYLGKKDRNLFCIYENNKILTSLKTAIEETTPKIQVALMDHKNTIKAYLSHKPLIGVKYGLYINGIKAKGVSTIVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVPRKENEGKYYLYRLYFNDLSKEGKHINKITYAVDPYAVSVGVNGEKGALVDLFSKECVPEGWNKYNKPKLINKEDSIIYEMHIRDFTINENSGVSERLRGKFLGAVEEGTFYINKENGNKVKTGLDHLKELGITHVHLLPVFDFASVNEEISNDENNRNWGYDPKNFNAIEGSYSTDPYTPSRRIIEFREMIKRFHDNGIRVILDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKAWQVIEGIKGSINSITYKPMESINYLEAHDNYTLWDQIVKSQNHSVEKGHYRDFNEENILDNFYVKEDLLGASILFTSQGIPFIQSGAEILRSKDGDHNSYKSPDSINALNWAEKEKYIDVFNYYKDLISLRKNHSAFRMKKPEDIIENLEVYFYDNNDTSGVIIAHYKNNANEDLWKDIVVIYNGTTIDDYNVISSMPKSSNGFWNIAVKNGGVNQLGIERVSEDEIPKIKSHSMMILYDE

SEQ ID NO: 14146 - protein, 217 aa, Clostridium perfringens str. 13
MVKIAPSILSADFSILGEQVKRVEKGGAEFLHIDVMDGHFVPNISFGFPIMKAIRNLSNLVFDVHLMIEEPGRYVDEFISAGADLITVHYEADRHIDRTINYIKSKGCKAGIALNPGTPVSMLKNLIPSLDMVLIMSVNPGFGGQSFIPYSLDKIKEVKEMAKACGKEDLLIQVDGGVGANNIKEIVEAGANVLVAGSAVFKEDKIEENIKALREAL

SEQ ID NO: 14147 - protein, 465 aa, Clostridium perfringens str. 13
MENKIHALREEGNLRVLPENKSEYKREFLAGTTSFLAMAYIIAVNPSILSAAGMPAGAIVTATCISAVIGCLIMGFYAKLPFGLAPGMGLNAFFTFSVVIGMGISWEVALTAVFVEGIIFILLSLFKVREAVVDAIPINLKYAVTAGIGLFIAFIGFNGAGVVIGNPDTMVAMGQVGPKMLIAMVGLCIIVILEKKKVKGSMLVGIVVSTLLAWGYALINTEAAASMGIYLPNGIFKFESIAPIAGKVNFSYLTSPQHVFNFITIVFTFLFVDFFDTVGTLIGVASRANMLDKKGRVPNAGKALMTDAIATTAGALLGTSTVTVYVESATGVEEGGRTGLTAITIGALFFVAMFFSPIFVAVPACATAPALIYVGYLMLTSVLKIDFSDITDAVPAFLIIALMPLTYSIGDGLTIGVLAYVILNILHNIFTKNKEDKKELSMVMIVLAIIFVIKLCLPLITQMIG

SEQ ID NO: 14148 - protein, 407 aa, Clostridium perfringens str. 13
MRYIVVGASAAGISGAKTLRELDKDAEIILVSKDENVYSRCILHHYISGHRDIEALDFTDRDFFEKYNIEWKKGLEVKSIDDREHIIGLSNGESLKYDKILLATGASAFIPPVENLREAKNVVGLRNLEDAIKIKEEAEKVKNVVVLGAGLVGIDAIAGLVGKNLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNVPDDSYTEEIDISGENYKKIIHKDGKIYGAIIQGDLSYAGVLTQLIKEKIHVSKVKKPLFEIDYADFFNIKENLEYTY

SEQ ID NO: 14149 - protein, 174 aa, Clostridium perfringens str. 13
MEDKNRNILLSEEQIKEQIAIVGKKLTEDYKDKNLYVLSLLRGSFIFAADLVRAIDTKAQIGFMTTSSYGHGEESTGIVKVVNDIPDNIEGLDVLIVDDIIDSGITMDFVINHVKSLGAKSVKTCTLLDKPSRRKVDLKPDYCCFEIEDLFVVGYGLNYGDHYRNIPYIFNWEK

SEQ ID NO: 14150 - protein, 245 aa, Clostridium perfringens str. 13
MIKVKNLKKSYKNLEVLKDVNMEVKQGEVVVIIGPSGSGKSTFLRCLNYLESPDKGEIQVGHVKVNAEKISKKEINDLRKQSAMVFQHYNLFNNKTVLQNVTEALIVVEKMDKKKAEEIALENLKKVGMVDKKDNYPNTLSGGQKQRVSIARAMAINPNVTLFDEPTSALDPELVAEVLAVIKDLAKEHKTMIIVTHEMSFARDVADRVVFMDGGIVLEEGTPEEIFKNPKNERTKQFLERFIVN

SEQ ID NO: 14151 - protein, 430 aa, Clostridium perfringens str. 13
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYIVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKEYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIVAIGVIALFQALQKKSAK

SEQ ID NO: 14152 - protein, 484 aa, Clostridium perfringens str. 13
MARILKTAYTFDDVLLVPNKSEVLPNEVSLKTQLTKKIQLNIPLMSASMDTVTESKMAIAMAREGGIGIIHKNMTIEDQAREVDRVKRQENGVITDPIFLSEDHTVREALDLMAQYRISGVPVTREGKLVGIITNRDIVFETNYDKKVSEVMTKSPLVTAKEGTTLTEALEILKQHKIEKLPLVDDENNLKGLITIKDIEKAKAFPNAAKDEKGRLLCGASIGVTNDMMERVDAVVKAKVDVIVLDTAHGHSKGVIEGVKRIKAKYPELQVIAGNIATPEAVRDLAEAGADCVKVGIGPGSICTTRIVAGVGVPQLTAVMDCAEEGKKLGIPVIADGGLKYSGDIVKALAAGACAAMMGSIFAGCEEAPGAIEIYQGRSYKVYRGMGSLGAMAKGSSDRYFQNGTKKFVPEGVEGRIAYKGHLADTIYQLIGGIKSGMGYLGAPTLENLYENANFVVQTSAGFRESHPHDINITKEAPNYSVNQ

SEQ ID NO: 14153 - protein, 356 aa, Clostridium perfringens str. 13
MLYSLILAGGKGTRLYPLSRSSNPKQFLSIHNNGKSFLSNTVDRIRPIIHKDNIYVVTNQEYEDKTRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADVILREIEKYIPKMYKCLMEIYQHIGEDDEEEIIKEQYSLIDGISIDFGVMQKTRRSFVIKCDFSWDDIGTFSALSRFLGHNGNNRTSDNVFLEECENCSVFGKEKLIIGFGIKDLVLVDAGDVILVMDKGRDQEIKHLLNSISGKKEFKEYL

SEQ ID NO: 14154 - protein, 459 aa, Clostridium perfringens str. 13
MKYTFPENFWWGAATSGPQSEGRFNKKHDNVFDHWFDINPELFHNGIGPNIASNFYNSYKEDLAMLKEIGLNSFRTSIQWTRLIKDFETGEPDEDGVRFYNGVIDECLANGIDIIMNLHHFDLPVELYDKYGGWESKHVVELFAKFAKTAFSLFGDRVKKWATFNEPIVIIEGQFLYKWHYPCIVDGKRGLQAAYNIALASARAIEEYRKLGQDGEIGIIVNLTPAYPRSESKEDLRAAEIANAFFNELFLDPATKGEFPKKLVEVLEKDGVMWNSTKEELEVIKNNTVDFLGVNYYQPRRVKDREEEYGGETWAPEKYFDNYDMPGKRMNPHRGWEIYPKAIYDIAKNVQENYGNIKWFISENGMGVEGEEKFKNAEGIIEDDYRIEFIIEHLEWLHKAIEEGSNCVGYHLWTPIDCWSWLNSYKNRYGFISLDLETQKKTIKKSGRWIKEVSKNNGF

SEQ ID NO: 14155 - protein, 458 aa, Clostridium perfringens str. 13
METLREKINKQREYFSTGETKDINFRIEKLKKLRDVLKSEEEKIFEALKKDLMKSSFESYVTEVAMVYDEINMHIKNIKKWSKKRRVKTPLVQLPAKSFIQLEPYGVVLIIGPFNYPFMLTMDPLIGAIAAGNTAVIKPSESAPETSKILKEILEKVFDEKYVLHVNPERGKEVVEELLKEKFDYIFFTGSATVGKIVMKAASQYLTPVTLELGGKSPCIIDKDCKLELAARRIVWGKLLNSGQTCVAPDYLYVHKDIEEEFIKKLEEEIKNQFGDNPLESEDYSKMVNEREFNRVLSYIDKEKLVFGGNYNIKTFQIEPTILKNVTWNDPVMEREIFGPIFPILPFENLDEVIRLVNSKDKPLAIYYFSEDKNKIEKVLNSTSSGGVTINDTLVHVSSSYLPFGGVGNSGMGEYHGKYSFDLFSNKKGVMNRKTFLDLKIRYAPFQNKLTIVKKIMK

SEQ ID NO: 14156 - protein, 453 aa, Clostridium perfringens str. 13
MAKVRSIYVCQNCGYETPKWMGKCPECNNWNTLVEEIRDTKSNQSSPKVERQIGELKKIKEIKSGEKERYDTGIGELNRVLGGGLVKGSLTLISGDPGIGKSTLLLQTANNISKKYGKVLYVSGEESEEQIKIRGDRLKVDAEELYIVSETNLDVIEAYIDKLEPAFIIIDSIQTIYRETVSSAPGSVSQVKECSNAVMRIAKGKNIPLFIVAHVTKQGDLAGPRVLEHMVDTVLSFEGERTEEFRILRTMKNRFGTTAEIGVFEMRGEGLMQVYDPSSMFLEDTSFNQEGSVVIGVMEGTRPILVEIQSLASETKAVMPRRTSVGVENSRLSLILAVLEKKLRVPFYNTDVYVNVVGGLEIEGTTADLGIAISLVSSVKGKAASLEKLVVVGEVGLTGEIRPISNCDRILNEAEKMGFLNAVVPYRSLEKLKGSKLNLIGVKTVREAIGKIF

SEQ ID NO: 14157 - protein, 482 aa, Clostridium perfringens str. 13
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 14158 - protein, 413 aa, Clostridium perfringens str. 13
MTVNEQNLKEEALRCLMCKNPRCKANCPISTPIPEVIGLFKEDKIKEAGEILFENNPLSVVCSIVCPHENQCKGNCIKGIKDTPVNFSEIEREISEEFLDNLELTQDTILEDKIAIIGGGPAGITAAFILAKKGYQVTIFDENDKIGGVLRYGIPEFRLSRDIIDKYEEALIKLNVKIRPNTLIGTVITLDMLKSDGYKAIFIATGVWNPKTLNVKGETLGNVHYAIDYLKAPKSYNLGERVVVIGAGNVAMDAARTAKRNGADTYVLYRKSFEDMPATKVEIEEAKEDGVKFELYKAPLEIYEDGVKYIQTERVISEDGRVSFKTLEGSEGVFKCDSIIVAISQAPRTNIVSSSRDLSTDKYGLVVTDEKGITTLNGVFASGDVVSGPKTVVEAVANSKKVAHAIDEFCKNN

SEQ ID NO: 14159 - protein, 183 aa, Clostridium perfringens str. 13
MIRDIKDDVKKVLYSEEQLAKRVKEMAEEISKDYAGKDLLVVGILKGSVLFTSDLIKNISIPCEIDFMAVSSYGNSAQTSGVVRILKDLDSDIENKHVLIVEDIVDTGTTLSYLLEYLKARKAASIEIVALLDKEARRTSNVSAKYKGFDVPDEFIVGYGIDYAEKYRNLPFIGALKEEIYNK

SEQ ID NO: 14160 - protein, 417 aa, Clostridium perfringens str. 13
MKYDLVVVGGGPAGLAAAYEAHENGVEKILIIERDKELGGILNQCIHNGFGLHTFKEELTGPEYAGRFIDMVEGTNIEVMLDTMVLEIEGKIIHAINTEKGYLTIEAEAIVLAMGCRERTRGAISIPGDRPSGIFTAGAAQRFINMEGYMVGKKVVILGSGDIGLIMARRMTLEGAKVEAVVELMPYSNGLTRNIVQCLEDYGIPLYLSHTVIDVKGDGRLEKVIIAKVDENRQPIKGTEIEFDADTLLLSVGLIPENELSKNAGVELDLRTNGLVVSESMETNREGIFACGNVVHVHDLVDFVTEEAKNAGKNAAKYIKGKKRLNHFTEIKNGENISYTVPQKFEIESLDGNLNVFMRVRNVFKNKQIVVRDEEGNVIQSFKKPHVVPAEMERITIFKDKLKNAKGAITISLEDGE

SEQ ID NO: 14161 - protein, 235 aa, Clostridium perfringens str. 13
MVNQFLAELFGTALLILLGDGVVANIALKKTKGNGADLIVVTVGWAIAVAIPVYIFSRVSGAVFNPAVTIALGITGGLTWSQVIVFCIAQFIGAFIGAVLVYLTYYTHFESTEDHDAKLGTFCTIPAIRNFKWNFFTEFIGTFVLMFGILGLGDAKMADGIMPIAVGLLILVIGVSLGGPTGYAINPARDFSPRLAHFLLPMKNKGGSDWAYAWIPIVGPILGAIAGAMVYTNIF

SEQ ID NO: 14162 - protein, 430 aa, Clostridium perfringens str. 13
MNNFFKLKEHETNIRTELLAGLTSFFAAVYIIVVNASILSDGGVSMEPLIIATVLASLIGCVLVALLSNAPLIIMPGMGINALFTYTIVNTMGLTFQQALAAVIVAGILFIVVAVTPLADMLTSSIPTSLKEAITVGIGIFITFLGLQKAGLIVGDASTLVKLGDISSKEVIVFFITMILMLVLFIKDVPGSFLIGILSGTIISMLFGIVDLSNFQFSLPNFSEYKQVFLSANFSGITSISFWIATFSLTLVLVFENIGLLHGQIDGMLKQPSKRQRALNAVAFTTIICGICGTSPSVSTVEGSAGIAAGGKTGLTSIFTGFLFLISIFFIPVISLIPNSAIAPVLIIIGGLMIQNIVSINFEDFTESFPAFLTLTIIPLTFSIVDGIAFGFIAYPICKLATKKYKDVSIPMYVISAIFLVYFVLHATQI

SEQ ID NO: 14163 - protein, 381 aa, Arabidopsis thaliana
MDLVRLRDIGSISPQRRRKWLILLAVFGVSGYGVYRVYNSQYIAKKTKRLMKLFSGIVSFAEMVIDSAETISIVSRDLKEFLESNSHEIPNSLKQLSKITKSKEFTDSLARVSEAVAIGVFRGYNSDPNVEKESNLSVVDRVFSEEGAGFVSVVVGSFAKNLVLGFYSGEIEIGSDDSLKPRWMNLLSDDKCRELLADCIERFTSSAVSVYIDKTVGVNTYDQIFAGLTNPKHRDSARDVLVSVCNGALETFMRTSHDVFTSSGEKTDSSLRKSENRENGWAEALSTTLAVPSNRKFMFDVTGRVTLETMRSILEFVILKTSQSFKRSLDVIHEEVTERGRQVVGYVGAKSSVIITVCLAVYFHIFNRFVRGPPVCLSQQF

SEQ ID NO: 14164 - protein, 144 aa, Chenopodium rubrum
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGYHGGGGSCYHYCHGRCCSAAEAKALEATTAQVKPQN

SEQ ID NO: 14165 - protein, 394 aa, Trametes versicolor
MSKKAPQLSRFWAQSRPPPPPTKLGHHRQLAPNAGLHVSPLCLSAMSIGEKWGPLGMGEMTKEQSFKLLDAFYAAGGNFIDTANNYQDGESEQFIGEWMEARGMFNQMVIATKYTSNWKRGESLPQKTSYVGNNMKSLYISVEQSLENLRTNYIDILYVHWWDWTCGVEEVMNGLHHLVADRKVLYLGVSDTPSWIVAKANMYARLTGKTPFVVYQGAWSVLQRDLEREIIPMARAEGMAIAPWNVLAAGKIRTDAEEERRRQTGEHGRKTASDAWERTPEQREVCKVLEKVAGKVGAKNITAVAIAYVMQKTPYVFPIIGGRKVEHLHANIEALDITLSEEHIEEIESAHPFDVGFPHNMVGDGSWYSPLYQSAGYFEKWPKQQAIKPALTGQ

SEQ ID NO: 14166 - protein, 339 aa, Arabis gemmifera
MGEAVEIMFGNGFPEIHKDTSPIQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVKGELMYLNAPSFVSAATLNKTISLALEKETEVYSEENARFIHGHGVAYRHI

SEQ ID NO: 14167 - protein, 412 aa, Rhodococcus sp. I24
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 14168 - protein, 1551 aa, Venturia inaequalis
MAYAGTKGDGIIRTASGHETYAPDGLGTPQREYEEEIAPSEDPSRATSERYAPITGHLYRRNSSDTEKGSDEDFTMATRSKSFTENMDTDDKDKLNRILTSLSQHQTRSSTLRRNDTISGLKEDDPVFDPSHKDFDLYKYLRLFMRDLQADGRETKKAGIVFRNLSVSGSGAALQLQSTVSDFVLAPFRLRELFSSSKSHKQIIDKFDGVLKSGELLIVLGRPGSGCSTFLKTLCGELTGLTVDKGSVIHYNGIPQKKMIKEFKGEVVYNQEVDKHFPHLTVGQTLEFAAAVRTPSNRLHGESRTEFSSQVAKVVMAVFGLSHTYNTKVGNDFVRGVSGGERKRVSIAEMAVAGAPLAAWDNSTRGLDSATALKFVEATRISADLTGSSHAIAIYQASQAIYDRFDKAVVLYSGRQIYFGPASKAKQFFEEQGWYCPKRQTTGDFLTSITNPSERRPREGMEKQVPRTPEDFEKYWRNSEMYQSLQKEIEDHETEFPIGGETLGKLQQQKRNAQASHTRPKSPYMISVPMQIKLCTKRAYQRIWNDMSSTLTMFISQIIMSLIIGSVFYGTPNATAGFFSKGAVLFFAVLLNALVAMTEINSLYDQRPIVEKHNSYAFYHPATEAIAGIVSDIPVKFLLAVGFNVIFYFLAGLRREPSQFFLYFLVSYVIMFVMAAVFRTMAAVTKTISQAMSLAGVLVLALVIYTGFVIPVSYMKPWFGWIHYINPIYYAFEILIANEFHGRDFTCSAIIPAYTPLQGDSWICSIVGAVPGRRTVSGDDFIMQMYQYSYSHVWRNFGILLGFLCGFMCIYFVGVEVNSSTSSAAEFLIFRRGYVPAYMQDDPKHAGNDEEKMADGTTDAKEDGGDVSAIPPQKDIFTWRDIVYDIQIKGEDRRLLDHVTGWVRPGTLTALMGVSGAGKTTLLDVLAQRTTMGVITGDMLVNGKPLDASFQRKTGYVQQQDLHLETATVRESLRFSAELRQPKTVTLQEKFDYVEDVIKMLNMEDFAEAIVGSPGEGLNVEQRKLLTIGVELAAKPKLLLFLDEPTSGLDSQSAWAICAFLRKLADAGQAVLCTIHQPSAILFQEFDRLLFLAKGGKTVYFGPVGKNSETLIDYYESNGARKCGEEENPAEYMLEIVNKGSSGQGQDWHEVWKGSKEREAVNEELKQIHKEKEGEAIAGANEEGAQDEFAMPFTAQVKAVTVRVFQQYWRMPSYVFAKWALGIASGLFIGFSFFQANTTQQGVQNVLFSAFMIATIFSSLVQQIMPLFVNQRSLYEVRERPSKAYSWKAFMIANIVVEIPYNIFLGVPVFACYLYAIAGIISSVRQVLILLLMIQFFVYAGTFAAMCIAALPDAETAAAVVTLLFATSLTFNGVMQSPQALPGFWIFMYRISPFTYWISSLVSTMLHGRRIECSSSETSRFSPPAGQTCQQYLADYLQTAPGTLQNPNDTTNCRYCSLSTADQLLAGSNVKYDTRWRDFGIVWSYVIFNIFVAVLTYYLFRVKKWNKGTGKSDGAKKAGFLGKILKKGANKGNDAKTEKGEQQANQHQRAI

SEQ ID NO: 14169 - protein, 1489 aa, Venturia inaequalis
  misc_feature (846)..(846): Xaa can be any naturally occurring amino acid
MGPDGPAPAHARGIEKESLQNPHSHDGTIADLTDEKESQSSHEGHERTWGAIQSPTSVNVSSAEAQFAELSKELSRNSHKDRLSRQQSHQSRRTISKNVDQEKTIGLSDSASSDSSEPFDLEAILRGNKREDEAAGIKTKKIGVVWEGLSVSGIGGVKNYVKTFPWAFVSFLNVYETAKGILGVGKKGKEFQILRDFGGVVKPGEMVLVLGRPGSGCTTFLKVIANQRFGYTKIDGEVMYGAFGSEEFSKRFRGEAVYNDEDDLHHPTLTVGQTLDFALETKVPGKRPAGLSRPDFKNKVIDLLLNMFNIAHTRNTIVGNPFISGISGGERKRVSIAEMMVTGATVCSWDNSTRGLDAATAVDWSRSIRVLTNIYKLTTFVSLYRASENIYEQFDKVMVIDEGRQVFFGPANEARGYFESLGFLEKPRQTTPDYLTGCTDPFEREYKDGRSSDNAPNSPDTLAEAFKNSKYHAQMKETMDTYKEQIGKEKEVYDDFQLAFKESKRHTSGRNVYTIPFYLQVWALMKRQFLLKWQDKFSLSVSWITSIVIAIVVGTVWLDIPTSSAGAFTRGGVLFIALLFNAFQAFSELASTMMGRPIVNKHRAYAFHRPSALWIAQIMVDMVFSSAQIMVFSIMVYFMCHLVRDAGAFFTFYLMIVSGYLAMTLFFRTVGCLCPDFDVAIRLAACIITLFVITSGYIIQWQSQQLWLRWIFYINSLGLGFAALMMNEFKRIDLTCEGTSLVPPGPGYTDLNHQVCTLAGSVPGQARVSGSAYIGSAFSYDPSDLWGYWGITIGLIIGFLLANAFLGEFVKWGAGGRTVTFFAKENKETKKLNEELTRRKDSRQKXETQGSSELNITSKAVLTWEDLCYDVPVPSGQLRLLNNIYGYVKPGELTALMGASGAGKTTLLDVLASRKNIGVITGDVLVDGIAPGIAFQRGTSYAEQLDVHEPAQTVREALRFSADLRQPYETSQEEKYAYVEEVISLLEMESIADAIIGEPENGLAVEQRKRVTIGVELAAKPELLLFLDEPSSGLDSQSAFNIIRFLRKLSAAGQAILCTIHQPNSALFENFDRLLLLQRGGQCVYFGDIGKDASVLREYFAKSGAHCPPKANPAEWMLDAVGAGMAARIGDKDWGEIWKDSDEFAQAKAEIVRLKAERTKAIGDLAPVEQKEYATPMWHQIKLVCKRQSLSFWRTPNYGFTRFFNHVAIALITGLAYLTLDDSKTSLQYRVFIIFQVTVLPALILAQVEPKYAIARMISYRESAAKAYKTFPFALSMVIAEMPYSVLCAVGFFLPIYYIPGLNSASSRAGYQFLIVLITELFSVTLGQMIAACTPSPFISALVNPFIIITFALFCGVTVPKPQIPGFWRAWLYELDPFTRLIGGMIVTELQDLPVQCTPQELNAFTAPAGQSCGEYMSAFFQTGGAGYLVNNATSNCEYCAYTSGQQFFQPLGYEFAHRWRDLGIFAAYIGSNLIILFLAARFLNFNKR

SEQ ID NO: 14170 - protein, 413 aa, Pichia angusta
MKLSFPTLYSLALVLGLVSLADAKVHKAPIKKAPAQATYQDVTVGDYVESLKQKYVTTYNKFIAAQQNDQQIISIGKRSDESASSGHNTPLTNYLNAQYFTEIQLGTPGQSFKVILDTGSSNLWVPSSDCTSLACYLHTKYDHDESSTYQKNGSSFAIQYGSGSLEGYVSQDTLTIGDLVIPKQDFAEATSEPGLAFAFGKFDGILGLAYDTISVNRIVPPIYNAINLGLLDTPQFGFYLGDTSKSEQDGGEATFGGYDVSKYTGDITWLPVRRKAYWEVKFSGIALGDEYAPLENTGAAIDTGTSLIALPSQLAEILNSQIGAEKSWSGQYQIDCDKRDSLPDLTFNFDGYNFTISPYDYTLEVSGSCISAFTPMDLPAPIGPMAIIGDAFLRRYYSVYDLGRDAVGLAKAV

SEQ ID NO: 14171 - protein, 449 aa, Streptococcus agalactiae
MTITAEDIRREVKEKNVTFLRLMFTDILGVMKNVEIPATDEQLDKVLSNKAMFDGSSIEAFVRINESDMYLYPDLDTWIVFPWGDENGAVAGLICDIYNAEGEPFCRRFHVKFQRNMKRMNRVGYNSFNFRTRPDFLLFKLMKCNQHLIDCYCPRRPTLTLAPTDLANNNRREIVSLNTNWALKLKLVIMKLAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 14172 - protein, 465 aa, Amphicarpaea edgeworthii
VGFKAGVKDYKLTYYTPDYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRNLAREGNDIIRAATKWSPELAAACEVWKEIKFEFEAMDTL

SEQ ID NO: 14173 - protein, 465 aa, Apios taiwaniana
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 14174 - protein, 465 aa, Butea minor
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFDAVDTL

SEQ ID NO: 14175 - protein, 465 aa, Canavalia rosea
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14176 - protein, 465 aa, Chadsia versicolor
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPNSYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14177 - protein, 465 aa, Cranocarpus martii
VGFKAGVKDYKLTYYTPEYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 14178 - protein, 465 aa, Dalbergiella welwitschii
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14179 - protein, 465 aa, Dewevrea bilabiata
VGFKAGVKDYKLTYYTPQYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14180 - protein, 465 aa, Galactia tashiroi
VGFKAGVKDYKLTYYTPDYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMMKRAIFARELGVPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKAIKFEFPAMDTL

SEQ ID NO: 14181 - protein, 465 aa, Glycyrrhiza glabra
VGFKAGVKDYKLTYYTPEYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPVSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEVIRQACKWSPELAAACEVWKEIKFEFPAMDTL

SEQ ID NO: 14182 - protein, 465 aa, Mucuna macrocarpa
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFPAMDTL

SEQ ID NO: 14183 - protein, 465 aa, Mucuna nigricans
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14184 - protein, 465 aa, Phylacium majus
  misc_feature (458)..(458): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHVHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNDIIREASKWSPELAAACEVWKEIKFXFEAMDTL

SEQ ID NO: 14185 - protein, 465 aa, Platycyamus regnellii
VGFKAGVKDYKLTYYTPQYETKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEDMMKRAVFARELGVPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNTIIREASKWSPELAAACEVWKEIKFEFPAMDTL

SEQ ID NO: 14186 - protein, 465 aa, Poecilanthe itapuana
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 14187 - protein, 465 aa, Rhynchosia minima
VGFKAGVKDYKLTYYTPDYETKDTDILAAFRVTPQPGVPAEEAGAAVAAESSTGTWTTVWTDGLTSLDRYKGRCYHIEPVPGEETQFIAYVAYPLDLFEEGSVTNMFTSIVGNVFGFKALRALRLEDLRIPISYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHVHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKAIKFEFEAVDTI

SEQ ID NO: 14188 - protein, 315 aa, Phaseolus lunatus
MSNFPVINFERLNGEERKDTMEKIKDACENWGFFELVNHGIPHDLLDTVERLTKEHYQKCMEERFKELMASKGLEAIQTEVKDMDWESTFHLRHLPESNISEVPDLVDEYRKVMKDFALRLEKLAEQLLDLLCENLGLEKGYLKKAFYGSRGPTFGTKVANYPPCPNPELVKGLRPHTDAGGIILLFQDDKVSGLQLLKDDQWVDVPPMRHSIVVNIGDQLEVITNGKYKSVEHRVIAQTDGTRMSIASFYNPGSDAVIYPAPELLEKEAEEKAQLYPKFVFEDYMKLYAKLKFQAKEPRFEAFKASNFDPIATA

SEQ ID NO: 14189 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 14190 - protein, 306 aa, Pyrobaculum aerophilum str. IM2
MSLELRGIVKSFGDFSLGPINLKIESGERVAVVGPSGSGKSTLLRIIAGLTPPNGGAVFINGTDATKTEPWRRGVGVVFQTPALFPSLTVLENVAEPLLSRGVSKGEAYGRARDVLVRLGLGDLVHRYPAQLSRGQQQRVSLARALVLEPQILLFDEPLTALDPPLRGEVLPYIYEASRGRTVLYVTHDFEEATFIARRVVVIMNGRVVADGDSVEIFENPPSSAVAEFLGYSNKLPADCGHLYFRPWDVRPGSGYRGRVIAVWYKAGKYEVLARVSDSYIRLHWPHKPPTDIIEFDIARGKCFRD

SEQ ID NO: 14191 - protein, 423 aa, Pyrobaculum aerophilum str. IM2
MLFERAKSVFPGGVNSPARALKHLPSPLVAKAASGAYLYTDRGKLVDYCMAFGAIILGHAHPRVKKAVEEQLEKGWIYALLTEQEVEFAERIRRHMPSVEKMRIVNTGTEATMSAIRAARGYTKRDVIIKFEGNFHGSHDYVLVKAGSGAATWGIPTSAGIPQEVARLTVVVPYNDIDAFIKAVREVGDRLAAVIVEPVAGNYGLIIPDVEFLKALREETQRAGALLIFDEVITGFRVGLGGAQGLFGIRPDLTTLGKVVGGGFPIGIFGGRGEVMDLVAPSGPVYNAGTYNAHPVSIAAGLAVLKELETGEPYRIANEAAERLAKGVEDVAGRLGFDVVVKRMASMFQFYFKKGDVKTPQDVRESNEKMYLKLHEIALKHGVYLTPSQYEVNFTSAAHGREVVEETLAALEKSFQELQREIG

SEQ ID NO: 14192 - protein, 419 aa, Pyrobaculum aerophilum str. IM2 [sequence omitted]

SEQ ID NO: 14193 - protein, 461 aa, Pyrobaculum aerophilum str. IM2
MSAPRGDHAILRARNLTKRVATLGPSTDVLRPDELIKFLDLVDGVRINLAHASPNEVKFRIEAVRSYEKAKNRPLAVIVDLKGPSIRVGSTSPINVQEGEVVKFKLSDKSDGTYIPVPNKAFFSAVEQNDVILMLDGRLRLKVTNTGSDWIEAVAESSGVITGGKAIVVEGKDYDISTPAEEDVEALKAISPIRDNIDYVAISLAKSCKDVDSVRSLLTELGFQSQVAVKIETKGAVNNLEELVQCSDYVVVARGDLGLHYGLDALPIVQRRIVHTSLKYGKPIAVATQLLDSMQSSPIPTRAEINDVFTTASMGVDSLWLTNETASGKYPLAAVSWLSRILMNVEYQIPQSPLLQNSRDRFAKGLVELAQDLGANILVFSMSGTLARRIAKFRPRGVVYVGTPNVRVARSLSIVWALEPLYIPAENYEEGLEKLISLKGTTPFVATYGIRGGVHSVKVKL

SEQ ID NO: 14194 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 14195 - protein, 314 aa, Pyrobaculum aerophilum str. IM2
MGPVEINKYTLLHGLNGGVYELEERLYSLLNERAKFNVPPLINGVLAPIIASEVSKRHKPVVAYLGPEKSFTWEAAAALFPQGDLMPCKSISEVFDKVESRAADYGVVPFINSLEGPVGETIDMLATHNLNIVTMGEMRITLCIAKKGAPRVIYTHPHAAAQARRAVAALGAHVVYTNSTSEAVKEFEKCERDCAVLASPKALEAVERTCGVEDGESYTRFAVISRAGRESGERAVLIFAVPNVAGALYKALGPIANRGINMTLIYSRPTRLSPWDYYFVVEVEAGEGLDDAVEEMKRYTTMLKVAGRYNVIRI

SEQ ID NO: 14196 - protein, 131 aa, Pyrobaculum aerophilum str. IM2
MEARPLATPEEAWRIASSLRYRHIEGTVVAVVQDVETKEVLMVGHMDPIAVVLTLTTGLAHYYSTTRKRIWLKGETSGHYQIVKEFRSDCDGDAVVIKVVQIGAACHTGSRSCFESKYSLIKALKLSLRHG

SEQ ID NO: 14197 - protein, 331 aa, Pyrobaculum aerophilum str. IM2
MCLKYYEALIRDGGFKVGTVEEASCLSYLFDRRVEVGEEVKLEELYPTPNHHRVYLNSLDLLRGGWPTPLLKISERPKEAYAKLEWYNPFSGSVKDRTVYYLLKSVEGDRLVEVSSGNVAIALAALGNVMGKRVKIYIPTAGKYVTPLLDFLGAEWQVLDVSMTVEALEHLEKDIREGAVHPNQFGNDLNFIAHLRTAAEIDWQLSAVGRRPDYIVAGIGTSGHASALGFYFGVRYGAKLIAVQPKDWIPGIRRVESGMKWIKYVNAEILDISLSEALEGVREFARRHGLLIGPSAGAVYAAFSKIEYQGTLVLVFPDSLFKYTALLEQLR

SEQ ID NO: 14198 - protein, 254 aa, Pyrobaculum aerophilum str. IM2
MEEAVRRGGKMALIEVNKIKKRYGKVEVFNDLSIDIETGEFVALLGPSGCGKSTLLRIIAGLERPDSGEVRFRGEPVRGPRREIALMFQSPTILPWKTAQDNVALPLVARGMGWREAREAAARYLALVGLSGFEEAYPKQLSGGMQQRVALARALAVEPEVLLLDEPFSALDPLTAESLRAELVRIWHENLSTVHTVIMVTHAVDEAVYMANRVVVLSTRPAKIVADIKINLPYPRNRKSPEFQKYLDQVYTYI

SEQ ID NO: 14199 - protein, 284 aa, Pyrobaculum aerophilum str. IM2
MRVGVVGLGIMGGPMAMHLHRAGLLAAVYNRTRAKAEPFEKLGVYVAQSPGDLAKRVDVVIIMVSDAPDVEQVLFGPGGIVEGARPGLIVVDMSTNSPDWARRFAERLAQYGVEFLDAPVTGGQKGAVEGTLTVMVGGKEELFKRLLPVFQAFGKNIVYVGPVGYGQAMKLVNQVVAALNTVAMVEGLRLAKALGLDMDKVVQVLTGGAARSGSIELYLPKLLKGDLTPGFKAAHLKKDLSYVMELANRASLSLPATALALELYKKMVEKGLGELGIHALGEIY

SEQ ID NO: 14200 - protein, 291 aa, Pyrobaculum aerophilum str. IM2
MSKVPGPIVLMEPLSGKTSLIIKINAIHVSKRSKYQGILIVDTDDYGRTLVLDDYIQSSYYDEIYYHESLVHPAVTTHPRPSDVLILGGGEGATLREVLKHNTVKRAVMVDIDGDVVELSKKYLPQMHQGAFDDPRSEVRIEDGFVYVENALKRGEKFDVVIMDLTDPYSSDIAKQLYTPEFFGKVKRLLREDGIVVTQAGNSFYFPEAYDYVLQGVKGNFPIIAEYSVWIPSFGYAVNFVLGSLKHDPHSLSAEEVDKRLSERGVRAEFYSGKTHIALMNMPVIKKILRV

SEQ ID NO: 14201 - protein, 408 aa, Pyrobaculum aerophilum str. IM2
MLLNEIIDLIPNINKCLKKGKTLIIRIDINSPIVNGKIIDDFRIRAHSYTLRLASDAGARAVVLAHQGRPGQDDFTSLEIHKPYIEKYLERPIKFVDDIIGPEARRQIKELKDGEILLLENVRILSEEVIEKVPEAQAETLLVRKLAPLADYYVFDGFAVAHRSQPSVVGFPIVLPSCAGPVFERELRALGAVFEKRGRGVTLIAGGAKMPDTLKAVEQLLKNGFVEKVAVGGLVGFVFALGKYGVLNSALKQEVEKGGFLPYIERARQLLAKYGAQIYTPVDFAVNQNGRLDVDIYSLAQPPLDIGRSTTIAFKEVIEQSEIVIFSGPMGYIEDERFATGTIELLKAASNRRLILGGGHTIMAAEKAGVLDKAYHVSTGGRAFIQTIGGEEMPAVKALLTSAKKFSL

SEQ ID NO: 14202 - protein, 448 aa, Pyrobaculum aerophilum str. IM2
MPKWHWPISPDDVPKIVVEPPGPKALEIVKRDEELIMQSFARWYPLVIARGYGPVVEDVDGNLYVDFNSGIAVTNVGHAHPKVVEAIKRQAELFLHYSLTDFYYEIAVKLAERLVSIAPISGRKKVFFTNSGTESVEGVLKIARGYFKGQRPYVIAFLGAFHGRTYGSMSLTASKPVHRRHFSPLVPNVIHAPYPHPVRCPFKASDPEECGEYALAFIEDWIFKRLVDPSEVSLVIIEPIQGEGGYVVPPKNFIQGLRKLTQKHGILFAVDEVQTGFGRTGKWFAVEHFGVEPDLIATAKAIAAGLPLGAIIGRAEVMSLPRGAHANTFGGNPVAAAAALASIEVIEEEGLLHHAQTLGEELKKFFKDEVGEKHDVRGLGLMIGIELLDERKKPAGYLDEVLLKAFKRGVAVIGAGISTVRVAPPLVIPRDMALRAAALITEILRRYR

SEQ ID NO: 14203 - protein, 244 aa, Pyrobaculum aerophilum str. IM2
MTTIVSVRNLQVAYGSLEVVKGVDLDVSQGEKVVIMGPSGSGKSTFLRSLIWLVRPKAGSIVIDEIEVSSRTLMEVRKRVGFVFQHYNLFPHLKVIDNIVLPLIKVHGLSRAEAVERALEALRLVGLEEKATAYPLQLSGGQQQRVAIARALAIRPKVLMLDEPTSALDPELVEEVLQVLENIAKRGTTMLIVTHEVDFALDVADRVVFFEGGKIIEQGPPDILYKPKTDRFRQFLKRLHKRTV

SEQ ID NO: 14204 - protein, 397 aa, Pyrobaculum aerophilum str. IM2
MGGSMRGFSPRIGALRESPTRKIDELREKLRRENRDVILLSTGQPSIPPPREVREALGELLKVDTMELYGYTPSQGIYEVRQAISEDLRRLGGLEVPPEQIVLTAGGQAAMFSTLATLIEPGDEVVVTDPTYFGYKPLLEYFGAVVKPVRTRLEDGFQPNPEALKDSVSRKTKALILVSPDNPTGRALKEEAAKAVVDLAEDYDFWIITDEAYKTLIYEGSHIYLYKLAPDRTISINTFSKDPAIPGWRLGYVYGPPEVMPKIKLVNEEMVYCPPSFAQRLVAIYLRSEARMRYIREVVEIYRQKRDVAVAALRKYVPEARFIVPAGSMFIFVDLSRYISDGESFARELLERYGVAVVPGSYFSEIYRAAVRISFVTEPPHRLEEGIRRIGEALKAT

SEQ ID NO: 14205 - protein, 267 aa, Pyrobaculum aerophilum str. IM2
MLKNKCGEKDVKLLGAPMEDTLSFRPGARFAPQKIRQILPYLEYTTLFGNVAEPICDLGDVELLQGRPEENLARIEAKLKRVGPPFIMIGGEHTATLAALNVVRPDVYVHIDAHFDLRNEWPPGQRLSHATFARRAHEELGFYAIYIGVRAYDDEEREYAENAGFFVVEGRDFTRQVVADALSTASGRAYVSLDIDVLDPAEAPGVGTPEAGGLSFKKLEYLLTDVLMTLKPVAVDIMEYSPPNDVSDITATKVVRILMHMASLLKI

SEQ ID NO: 14206 - protein, 384 aa, Pyrobaculum aerophilum str. IM2
MKEGRLVLYTGLGWMFDALDVLILSYLLVAMSNELKLDSQAKNWIVLANNLGMLIGAMLFGRLADRVGRKKVFMSTLLTYSIATAISAFARNWQEFAVIRFFVGLGLGGELPVVATYVSENSPPERRGRNVVLLESFWSLGAILAAAISLFLFTTIGWRSSLLLMGATAFYVFVIRFTLPESQRWLELREQRGGLFETRIIGEFVRRLTLVGAVWFLLAFGYYGAFLWLPTMLVRERGFTQVGTYEFMFLTTLAQLPGYFSAAYLVEKAGRRPVGSLYFALSALSAAFFISSNSYAELLLWALALNFFNLGVWGVVYAYTPELFPTSVRGIATGLAGSAARIGMILGPLLYPLYASTALLIIAIAWLVASALILLLPETRGRVV

SEQ ID NO: 14207 - protein, 448 aa, Pyrobaculum aerophilum str. IM2
MVRVVVVGGGAAGASAAARARRLDPSAEVLLIERGSMITHAPCGMPYAIGGIVKSHEELMTYTPEEFEKERNIKVMINTEVVDVDADKKVVVVKKGGSEEKIPWDKLVIATGAKPLVPRIPGVELKGILTMRHPDEVPHLKGHIDKAKTVAIVGGGYIGVEMAEVLLELGKRFLLFEMFDQVLPAALDPDVAGIVAEEMKTRGVELHLGEKVVEFRGVEHVNKVVTEKGEYQVDEVILAVGVRPDVDLAVRAGAKLGETGAVYVNEYMETTVPDVYAAGDVAEKVHRVTGRRVWIPLAPTANKEGQVAGGNAVRNRILKFPGVVGTAVTKFYNLYIARTGLSEKDAAQLGFKTQSALIKARTKAHYMPGAETVHVKLIAEESTGRILGGQIVGKSPVVASYADILAVAVQSGYTVSDLFFSDIGYMPDTAPVWHPLIVAARVLSRGKL

SEQ ID NO: 14208 - protein, 383 aa, Pyrobaculum aerophilum str. IM2
MRKGTVAVRGYKHSDPYGALQPPIYLTALFRMEGEALKSDRGFDLKYSREENPTLRPLEEVVANLEGGVDSLAFNSGMAALSTVFFSLLSADASVLTPMEAYGATLRLLNALEKYGVRMRKAYPDTETYIEALKAVKPNLAFFETITNPMLRVLDGPEIIKAAKDLGAVVVVDNTFATPVLTTPISYGADVVVHSATKYLAGHNDVVGGIAVVARGDLLEELWIWRAMLGSIMQPFEAFLTLRGLKTLFVRFEKQCKTAMAVAQFLEGHGKVAEVIYPGLSSHPHHATAKRLFGDKFGAVVSFRIKGGRDAVVRFFKSLRLITPGPSLGGVESNATYPVASAASPIPEDERKILGITEDLVRLSIGLEEAEDLIEDLDRALNS

SEQ ID NO: 14209 - protein, 233 aa, Pyrobaculum aerophilum str. IM2
MLSKPGLGVYLVASWPSKDTYEKAIRGLEGIADFFELGLPSKNPKYDGPFIRKAHREAGEPLWLRPQAPTYIMTYWEEHRGNLDGLFTLAAEIRARGVLAPDLLIDFPEELELYLKYAREYALAPAFFVPGKFPHWLVKRLTSAEPDFIYLGLYAATGVELPVYVERNVKIIRQLAGDVYIVAGFAIDSPSKAARLIEAGADGVVVGTAFMRRLQNSVDSALSFLKSIKEALK

SEQ ID NO: 14210 - protein, 422 aa, Pyrobaculum aerophilum str. IM2
MKFWSVTLSGKLAICEGESCLTYRELFEKATKWALNSRVVFAARNSLWSYAALMGLLHGGGEVALVDPLTVSEDLKMIIEDFSPDLIVGDEEFLQQNAEVLKNYKTLSVNSPPNGGGWTYDTTFVMYYAGIAGRTMQVLNKTSSLWINAHSLALAMGLEKADVVYVTAPITHVLGLVTSMAALAAGGMVRLMKKLSPNVVEELSKATVIVGAPAFYAEVLKIGVGKLGAKFAVSGGAYLAPDLRARFEEVTGVRILQVYGLTEGLVLTFEPPSAYGKGSVGAPLPLVEIRLLEDGELAVKAPWVMRGYKDPEETKRAFIDGWLRTGDILEEREGLLYFKGVKKRMIKYKGYPIFPRDLEEILKRHPAVLEAKVVGELHPEYGEVPVAYIKVKGEVSEENLLNFINSQVAFYKRLKKIYIERI

SEQ ID NO: 14211 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 14212 - protein, 383 aa, Pyrobaculum aerophilum str. IM2
MGRIAKYYREYGIRIVKGFMQYVWDDKGQRYIDCNTNHGVVFLGHANPKIVEAVKKQVEEIWAVPLNFATPARERFIEEFSKLLPPKFGVVFLQNTGTEAVEVAIKIAKKVTRKPTIVAFTNSFHGRTMGSLSITWNEKYKKAFEPLYPHVRFGKFNVPHEVDKLIGEDTCCVVVEPIQGEGGVNPATPEFLKALREEAQRKGALLIFDEVQTGFGRTGAVWAFQKYGVEPDIFTAGKPVAGGLPIGLAVAREDFGDVFEPGEHGSTFAGNAVVMAAAAAASRLLREEDVPGRAERIGAELAKALGDTGSRLAVRVKGMGLMLGLELRVKADQFIQPLLERGVMALTAGVNTLRFLPPYMISKEDVEVVHAAVTEVLKKAEQQ

SEQ ID NO: 14213 - protein, 501 aa, Pyrobaculum aerophilum str. IM2
MESITSIEMYVADRNAEWLGVPRLVLMENAGAAVARNVLRKFPTAKRILVVCGTGDNGGDGYVAARHLHAAGRTVRVIALGEPREELARINYQAVTRLWGVEVKAAQLPLELLALQDWFMWAEVIVDAVLGTGIRGVLREPHATAIELMNISPAPKVAVDVPSGLDPDTGEVRDKAVRAALTVTFHKAKRGLLAPGAQRYVGELVVEPIGIPPEAELVVGPGDFAYLNFTRRADSKKGDHGRVLVIGGSLEYSGAPVYVALAALRAGVDLAVIAAPEPAAYAAKAISPDIIAIPLEGPRLSTKHVDKLASLAERFNVVAMGPGLGVEEETQEAVRELFRRLAGKRAMVIDADALKALRGVRASGAVVYTPHAGEFKALTGAEPPQSLSERMAVVREQAAALGGVILLKGRYDVISDGVRVKVNMTGTPAMTVGGTGDVLTGLVAAFLTKTSDPLEAAAVAAFVNGLAGEDAAAELGFHITASDLIERLPRVIRRYAFESIR

SEQ ID NO: 14214 - protein, 429 aa, Pyrobaculum aerophilum str. IM2
MPDGLAVWRVLRGAGVKLVKFVVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 14215 - protein, 467 aa, Pyrobaculum aerophilum str. IM2
MYDVVVLGGGSAGVAAAVKAAQLGAKVAVVNSGPLGGTCVNVGCVPSKFLIRAAQLKRYAERPFFKGISAKVEVAFDALLQHMKEVVEELRREKYEEVLKYYDVDIIEGYGYLKDAKTVKVGEREVRGEKIIVATGARPRVPEIPGLKEAMARGMAFTNEEFFKLDHMPSSIVFIGGGAIAAELSQALARLGIEVAVIYRSSFLKYEEEIASKFVEELLANEGVRLIKAAVTAVEIRGREVEVRHSGGSVRAEALFVAAGRAPNIEPLGGLLKLGPNGGVLVNERMETSLPGVYAAGDVTGGLEGARFLENAAARQGVVAAVNAMGGNAKFNPLAVPRVVFTDPAVASVGLREEDMIKGGIGCRCRAAPIEAVAAGWTKGQTTGFIKINTYPETWKVSVKRGKIAGALVVAPEAEELINVFAMAIQLGLTVEDLIEWLPSFPSYGEALRLAALAFYTDPTKLSCCGG

SEQ ID NO: 14216 - protein, 452 aa, Pyrobaculum aerophilum str. IM2
MKVVVVGGGPAGYVAAIRARQLGLDVTLVEAERLGGECTNYACIPSKALLHAAEAYRRAVSSPWITGTVSFRWKEAVQWKEKVVEKLRRGIEFLLSAAGVEVVRGLAKPGPGKTVEIDGRRLQYDFLILATGSEPVGLKELPFGRRVIGTREIFSLEEPPASVAIIGGGASGVEIASLFSMIGAEVHVVEAMERILPGLDPEISRQMERALSSRGVKIYTSSRVVKGEEGEGSVKLRISSPGGEREIEAELAVVAVGRRPRPGPFSAMGLEVDGRGAVRVDESMRTSVPWVFAAGDVTGPPYFAHKAYAQAKVAAEAIAGLKSAYSPRSVPAVIFSDPEVVSVGMTEEEAVAKGYRPKAVRMSLSALGKAVAAESEGGFAKLIYDAESRIILGVHIVGRGVSELAGEASALVEFYATVDDLALTIHPHPTLSELFAELAEAALGKPVHIAKL

SEQ ID NO: 14217 - protein, 1167 aa, Pyrobaculum aerophilum str. IM2
MTAVTRRGFLKLAALATSALSIGAEAQVPFKATKATWEIGEIGGKLDLPKATVTPVICPYCSVGCSIDLYVSGGRIVWSRGSADSPINWGALCPKGKAAFQLVENDLRVTKPLIRTGPKPPPEEILAAKSWDELIAVVRKYPPMWREATWDEALQLVANRLARILNEWRASTGSPKQKDGYYYVGRNVPIQIIGSSILVNEEAYLSKKLATYLGTSNMDSQYRKCHSSTVSSLAVTYGWGAETASIEDVALADVVLFWSSPAEAHPLSFAYFLKGKRERGTIFITFDPRYSRTAAASDLWVPFRPGTDTAILLYILHYAFFERNPPIDQLDEFQRLRSRWNITDDDLADLKELLKEYDADTVSNISGVPKDLLRTVASIYVENSGVVTNHEKHGIIQWAMGFTQHTNATINIIRAAAIVQLLLGNVGYPGGGTHPFRGHSNVQGANDVQGGGVDGLPGYHGFPASVFEIRLYQDWKLQGMPDAWNWSVPEWARASFSTTAPDAGKADLSKVLQVFKFYGWRRFELAWRMFCGTIPEDDPQNGVVVCDFPLGTGTTEVVFPRRALAGEIKAAFVFGENPAVTNPNAKIIMAGLAALDLLVVSDIFETETAWFADVLLPAASFAEKEGSRTNGNRVIQWSYRAVPPKGDSRPDYWIITKLYQYLRREGAVVLPSEVAGVKKEEVKFRKGGKLVFVYERPLRPDNSWDYSGGTGKSAPISPIEAEVNPRIIYKEINFTTLIYQGIYDPIRDEIITMKRIAQLRRPGQIDGTFSSKFEVYKDWGWSWPMNVRFLYNYDSLKAVLGVTDKVYAAGREWEVAGETGEWIDEYTGEYKPAFIPGHNFWVPRSFKRRLSGVADVYGGMDIMHFIKTGEVRILGKFIVEEGGEVKTLTYEEYVARTGMKYLWVNDSLYWDADTTSFKAALKRPFFSGGDWRSFKPVYQKMRDLLGQYYSQFGNLKDAVLKVISDMGGWYKGYSFQWPIHTEPVESPLPELAVRYPSLAWLNPYNLQVLQDQPDIVKGKNVGVALTPDDLKDIPGELVVITSNRLTEHFHGGSMSRNVPYLAELAPEPFVYLPRALAERLGVKSGDYVDVITLRGGLRMKAYVTDGEAYLTVNGKELPVVNVIWAFSFEGYVTGPQGNFLNPDVGDVVTTIQESKAWIGKIRKASLA

SEQ ID NO: 14218 - protein, 331 aa, Pyrobaculum aerophilum str. IM2
MRAAAFSTPGLENLKLVEAETPRPGPGEVLIRVKYAGVNPLDYNVVAGAVKASPMPHIPGSEFAGVVEEAGPGVTGVSRGDPVVVYNRLYCGHCRQCLTGWTQMCEVTGGGIIGIVTQGGYAEYAVVPAKNAVATRADLKEAATLPIGALTAWNMAYRASISPGEKVAVVGATGNVGIYAVQFAKLLGGEVYAISRRKAKVESILKSAGADAVLTPDEAKSAAPFDVVLDPTGSASWDLSFGVLGRGGRYVTAGALTGAEVRLDLRRLYGMQILVIGATGGRRADFNTVVRLLEAGRIKAFLHNVYPLADVRKALEELRSPERVGKVLIAP

SEQ ID NO: 14219 - protein, 461 aa, Pyrobaculum aerophilum str. IM2
MAKLKPDPTFYPTPRDAMRAPPEDIAYVAALYVGTGVNAPDFLAVVDVDPKSPTYGKVIYKLDLPYIGDELHHFGWNACSSAYCPNAKPFLERRYLIVPALRSSRIYIVDTKPDKRRPAVAKIVEPEVAVGRTGYTKYHTVHCGPDAIYISALGGPDGREGPGGIFLLDHDTFEPIGRWEVYRGPQYFAYDFWWNLPSGVMITSEWTVPRCFEEGFSLECLKEGAYGNKLHVWDLAKRRHLYAIDLGQEHRMVLEVRPLHDPTKLMGFVNVVLNTKDLSSSIWLWFYEDGKWQAERVIDIEAQPFEGPLPPVLKDFKMVPPLVTDIDISLDDRFLYVSLWGLGELRQYDITNPHQPRLAGRVKIGGLYHREPHPSGAEATGAPQMISVSRDGRRVYITNSLYSSWNNQFYPGLRGWMAKVNVNPEGGLELEKEFFVDFGRARAHQVRLWGGDASTDSFCYP

SEQ ID NO: 14220 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 14221 - protein, 336 aa, Pyrobaculum aerophilum str. IM2
MIVYYSEVFKRHVPPYRHPEAPDRLDYLIEGVREAGGRVKEPKMREDVWQLIHLAHDKNYVNLINKLCEKGQGEIDGDTYVSPGTCEAAALAVSAVADAVEKRETALIAARPPGHHAGFMGRALTAPTQGFCIFNTAAIAALYVGEGAAVVDIDVHHGNGTQEILYDKDLLYISTHQHPATLYPGTGYPEEVGEGRGEGYNINIPLPPQVGDDVYIKVVDEVVIPLLRQYDPKVIVVSLGWDAHRDDPLADLNLSLKSYLYFFDQVLKMQKLTVVVLEGGYNRSVIKNGTEALLRLALRGEFAPKESATETAHSVYKHFETTMREVRQYAGRYWRL

SEQ ID NO: 14222 - protein, 386 aa, Pyrobaculum aerophilum str. IM2
MLHVATPSEILSGRTTDVYFTRTVEVLKKAGLGDVRVRAEFHVSSLPKGYKWAVFTGLKEVVEVLRGKRVTLYAMPEGTLFYENDPIMVIEGPYLEFAVLETAILGIIRHYSSISTKAARVKKILGDKACLYFGARALHPAIQPMADRAAYIGGCDGVATVMGAELMGIKPSGTMPHALMIIFKAAVGDHTAAWVWFDKTMPSDVPRIILADTFLDEREEALLAAKILGDRLYGVRLDTPGSRRGNMRRIVEEVRWSLDLHGYKNVKIFVSGGLDEPQLEVLKDVADGFGVGTAISFPPSIDVAMDIVEVEVNGQWVPITKRGKLPGFKQVYKCGARHVITRWGDPPPCGDPLLAEWIKDGRVVRDLPSESEIRKYVLNQLAEVEL

SEQ ID NO: 14223 - protein, 347 aa, Pyrobaculum aerophilum str. IM2
MKFLLRCKPDTKKPPTGKKVAIIGAGPAGLGAAGILLCNGHEVHIYDALPEPGGLLMFGIPPFRIPRENVREGIRELVDAGAKFFTSTFVYCGEKPHEHEALLLAKDYVSLEELVGKYDAVIITTGTWKSRSLGVPGENLPGVYKALDYLFRIYAHQLGYLPKEKVYPTGRKVLVVGAGLTAVDAALEAREQGAEKIIVAYRRTINEAPAGRKTIETELIAKGIEFRELINPVAFLGRDRVERVRFVKMRLGPPDKSGRPAPEPIPGSEFEEEFVTVLIAAGEIATPPGKCLGMELNPDGTIKVNEKMMTTRRGVFAAGDVVTGPSLIGKALGSGMRAAQFVDEFLR

SEQ ID NO: 14224 - protein, 235 aa, Pyrobaculum aerophilum str. IM2
MSIEVVEVKPHERHYGVYVVKFEDGTERIATKNLTPGRRVYGERLIKWGGDEYREWNPYRSKLAAAILNGLKLVPIKEGTHILYLGAASGTTPSHISDIVGENGLIYSVEFSPRVFREFMEKLVDQGRRNVVPILGDARFPYQYAHYVKGVDVVYIDVAQPAQAKILADNADYFLKPGGHVMLVIKAMSIDVTAPATETFKQEINTLKERGFDILETVHLEPYDTAHAMVIAKKR

SEQ ID NO: 14225 - protein, 421 aa, Pyrobaculum aerophilum str. IM2
MAKIYIATDVLGFFAVDEANNIVDKELYERKLDLIASRLIELEKSNYVPELVALIERVKAKGDKIVLEDPELARKLVSVVRGVEIVGESPSPVLVAFRQNFEKYLPSLGLTWEEYRKLLFDVSDLITRLKLRQAVERRDLFIAQAISALDDVDKILNLIASRIREWYGLHFPELEELVRDNREYVSIVYHLGHRSRITEDSLKKAVANIPDDRAKKIVESAKKSIGAEMSEWDLDQLRAYADIFLRLDSYREKLATYIDEAMKEVAPNVRELVGPLLGARLIKLAGGLTRMAFLPASTIQVLGAEKALFRALRTGGKPPKHGVIFQYPEIFRSPRWQRGKIARALAAKLAIAAKADAFTGNFIAPRLKEELMKRIQEIKTLYAKPPPKAPAQPSARAPPPPPPPPRGGERRPPPRRERGRR

SEQ ID NO: 14226 - protein, 429 aa, Pyrobaculum aerophilum str. IM2
MPDGLAVWRVLRGAGVKLVKFIVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 14227 - protein, 484 aa, Arabidopsis thaliana
MAAKKVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 14228 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNARVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 14229 - protein, 227 aa, Chlamydomonas reinhardtii
MALTMRNPAVKASSRVAPSSRRALRVACQAQKNETASKVGTALAASALAAAVSLSAPSAAMADIAGLTPCSESKAYAKLEKKELKTLEKRLKQYEADSAPAVALKATMERTKARFANYAKAGLLCGNDGLPHLIADPGLALKYGHAGEVFIPTFGFLYVAGYIGYVGRQYLIAVKGEAKPTDKEIIIDVPLATKLAWQGAGWPLAAVQELQRGTLLEKEENITVSPR

SEQ ID NO: 14230 - protein, 203 aa, Mycobacterium leprae
MLVAQSFSAINPGPTAELYLGDIKSVMLTQEQIQARIAELGAQIGHDYRDRSPASDQDLLLVTVLKGAVIFVTDLARAIPLPTQFEFMAVSSYGSSMSSSGVVRILKDLDRDIHDRNVLIVEDVVDSGLTLSWLLRNLATRRPQSLQVCTLLRKPDALRANVDITYVGFDIPNDFVVGYGLDYDERYRDLPYIGMLDPRVYQQ

SEQ ID NO: 14231 - protein, 168 aa, Lotus corniculatus var. japonicus
MPRSRINGNFIDKTFSVVANILLQIIPTTSGEKEAFTYYRDGMSAQSEGNYAEALQNYYEAMRLEVDPYDRSYILYNIGLIHTSNGEHTKALEYYFRALERNPFLPQAFNNMAVICHYRGEQAIRQGDSEIAESWFDQAAEYWKQAIALTPGNYIEAQNWLKITRRFE

SEQ ID NO: 14232 - protein, 384 aa, Haloferax mediterranei
MSEDFYDVLGVSRDASKDQIKNAYRKKAAKYHPDVSDEEDAEEKFKKVQKAKEVLTDDEKRQMYDQLGHERFQQAQKRGAGGGGGGRGQGNPFGGGGNPFGGMGGGGFEDIFNNLFNGGGGQRRSRPQQGRDVAQRITIDLEDAYHGVERDVTIRRREVCPECDGEGHPADADVNTCSECNGSGQQTTVQQTPFGRVQQTTTCRACGGEGKTYSEDCSECRGSGRVRRTRDVTITIPAGFRDGQRLRYRGEGEPGENGGPNGDLFVEVNVRDHEEFDRDGDDLQYTHPISFPQAVFGATVEVPTLDGEAELKVPAGTQSGSTFTVSGAGMPHLDGRGNGDLHVEIHVVTPEDLNSEQREALKQFAEAGGEEVKESLFQKLKNSL

SEQ ID NO: 14233 - protein, 168 aa, Oenothera elata subsp. hookeri
MPRSRINGNYMDNTFSIVANILLRIIPTTSGEKEAFTYYRDGMSAQSEGNYAEALQNYYEAMRLEIDPYDRSYVLYNIGLIHTSNGEHTKALEYYFRALERNPFLPQAFNNMAVICHYRGEQAIRQGDSEIAEAWFDQAAEYWKQAIALTPGNYIEAQNWLKITRRFE

SEQ ID NO: 14234 - protein, 466 aa, Deinococcus radiodurans
MTTAQPDAQPGAQPIADLGLKPGQLHLNPGVDDLYAHAIRLGEGVQAATGPLTVRTNKTGRSPKDRFIVEDDQTRETVWWEGFNQPISAEVFDRLLDKMVKYAEGRELFVQQVFAGTDAEHRIPVRMITEMAYHSLFIRNMFVRPTAEELQNFQAEWTVLNIPSFKADPAVDGTRTDTFILVNFSKKMIIAGGTQYAGENKKGIFGVLNYLLPAKGIMPMHCSANVGEDGDVALFFGLSGTGKTTLSADPGRKLIGDDEHGWTDTGVFNFEGGCYAKVINLSAEAEPAIYQTTRNYGTVLENVVLDESGTPDLDDGSLTENTRSAYPIEQIANIQPGSVGGIPKNVVFLTADAFGVLPPLSRLTPEQMMYQFISGFTAKIPGTEEGVTDPTPTFSTCFGAPFMPRHPGEYARLLAQKVEESGAKVWLVNTGWTGGKYGEGHRMSLNLTRLKSRDSHFADHCPPKQV

SEQ ID NO: 14235 - protein, 1483 aa, Penicillium digitatum
MEARRHDPTASVNTEDTANEKSEVGDEKYTDAEVTRLAQQLTRQSTRFSVSPQNAENPFIETHEDSTLNPHSGNFKAKNWMKNLLAIQSRDPERYPKRQAGLAFKNLSVHGFGSPTDYQKDVANSVLEIGAFFRTMAGTGKQKIQILRDFDGLVKNGEMLIVLGRPGSGCSTFLKTIAGEMNGIFKDANSHMNYQGISDKEMRNQFRGEAIYTAETDVHFPQLSVGNTLKFAALARAPRNRLPGVSRDQYAEHMRDVVMAMLGLSHTINTRVGNDFIRGVSGGERKRVSIAEATLCGSPLQCWDNSTRGLDSANALEFCKTLNLMSKYSGTTCAVAIYQASQSAYDVFDKVTVLYEGRQIYFGRTTEAREFFTNMGFHCPDRQTTADFLTSLTSPAERVVKPGFEKMVPRTPDEFAKGWKNSAAYKELQKEIDDYNTQYPIGGESFQQFVESRKAMQSKGQRAKSPYTLSVAEQVQICVTRGFQRLKSDYSLTISALIGNTIMALIVGSVFYQLPDDVTSFYSRGALLFFAVLLNSFSSALEILTLYAQRPIVEKQARYAMYHPFAEAISSMLCDMPYKILNAITFNVTLYFMTGLRQNAGAFFTFMLFSFVTTLTMSMIFRTIASYSRTLSQALVPAAILILGLVIYTGFTIPTRNMLGWSRWMNYIDPIAYGFETLIVNEFHGRNFPCNPESFIPAGDSYADVGRFNKICSAKGAVAGQNFVSGEAYYTASFQYSNSHRWRNMGIMIGFMVFFMVTYLVGTEYISEAKSKGEVLLFRRGYAPKNSGNSDGDVEQTHGVSSAEKKDGAGSGGEQESAAIQRQTSIFQWQDVCYDVHIKNEERRILDHVDGWVKPGTCTALMGVSGAGKTTLLDVLATRVTMGVVSGEMLVDGRPRDQSFQRKTGYVQQQDLHLHTTTVREALRFSAILRQPRHVSHQEKLDYVEEVIKLLGMEHYADAVVGVPGEGLNVEQRKRLTIGVELAAKPQLLLFLDEPTSGLDSQTSWSILDLIDTLTKHGQAILCTIHQPSAMLFQRFDRLLFLAKGGRTVYFGEIGEHSSTLSNYFERNGAPKLSPEANPAEWMLEVIGAAPGTHSDIDWPAVWRESPERKAVQNHLAELRNNLSLKPVATTDNDPAGFNEFAAPFAVQLWQCLIRVFSQYWRTPIYIYSKTALCSLTALYVGFSFFHAQNSMQGLQNQMFSIFMLMTIFGNLVQQIMPHFVTQRSLYEVRERPSKTYSWQAFMSANILVELPWNALMSVLIFLCWYYPVGLQRNASADDLHERGALMWLLILTFMLFTSTFSHMMIAGIELAETGGNLANLLFSLCLIFCGVLATPDKMPHFWIFMYRVSPFTYLVSAMLSTGTSGAKVECESVELLHFEPTAGKTCFEYMNTYMNGLVVNGTQVAAPAGGYLVDNNATSNCAFCTIADTDTYLASVLSYYKDAWRNFGIMWAFIIFNIFGAVCIYWLARVPKGTRSKKTKTA

SEQ ID NO: 14236 - protein, 293 aa, Dryopteris caudipinna
  misc_feature (171)..(171): Xaa can be any naturally occurring amino acid
VGILPLSLQYGFSVANKFLQGAQSIDNHFKTAPFEKNIPVLLGLLSVWNVSFLNHPARAILPYCQALEKFAPHIQQLSMESNGKGVSIEGVPLSFEAGEIDFGEPGTNGQHSFYQLIHQGRVIPCDFIGIIESQQPVYLKGEVVSNHDELMCNFFAQADALAYGKTPEELXAEGVPEHLVPHKTFSGNRPSLSILLPKLTPYTLGQLLSIYEHRIAVQGFIWGINSFDQWGVELGKSLASHVRKQINASRSQGKSVAGFNYSTSTLLNHYLKVKSNVYTSTHDSFPPAILPPK

SEQ ID NO: 14237 - protein, 506 aa, Pyrus communis
MSPPEIAILILVFLTFLWSLLRLINVSSRQSRTLPPGPAALPIIGNLHMLGDLPHRSLQNLAKKYGPIMSMRLGSVPTIVVSSPKTAKLFLKTHDTIFASRPKLQASEYMAYGTKAMAFTEYGPYWRHIRKLCTLQLLCPSKIESFAPLRREEVGLLVQSLKVAAEAGEVVDFSEKVGELVEGITYRMVLGRKNDDMFDLKGIIEEALFLTGAFNISDYVPFLSPLDLQGLTKRMKRVSKTVDQLFEKIIQDHEQVSRSEQGNHHKDFVDVLLSSIHQTLKPNDEEVYMLERTNAKATLLDMIAGAFDTSATAIIWTLAELLRHPKVMKRLQEELQSVIGMDRMVEESDLPKLDYLSMVVKESFRLHPVAPLLVPHQSMEDITVDGYHTPKKSRIFINIWTIGRDPKSWDNAEEFYPERFMNRNVDLRGHDFQLIPFGSGRRGCPAMQLGLTTVRLALGNLLHCSNWELPSGMLPKDLDMTEKFGLSLSKAKHLLATPTCRLYNES

SEQ ID NO: 14238 - protein, 150 aa, Pyrus communis
MAEQGFMDKAKNFVTDKISNVAKPEAEVTDVDFKKMGLSHVEYLSKVSVTNPYSHSIPICDIKYTLKSVNREIASGTIPDPGSLKASDITVLEVLLKVPHSILVTLAKDLGADWDFDYELDIGLTIDLPVIGNFTTPLNKKGEFKLPTLF

SEQ ID NO: 14239 - protein, 142 aa, Narcissus pseudonarcissus
PCCDWYDVDCDSNGRVIGLSVFQDNLSGTLPPAIGDLPLLENLMFHKLPNLVGSIPSTITKLTHLSLLTLSWNSLSGPIPPFLSQLTSLTFLTLAFNKFSGSIPPSLANLHNLGALHLDRNQLTGPIPDSFGSFPASSPPDL

SEQ ID NO: 14240 - protein, 485 aa, Escherichia coli
MSDKSFIAVVMAGGTGSRLWPLSRELYPKQFLKIGGELSLLQSTLNRLSKLSFDAPLVITNDNHRFIVAEQLRQMNQLSGNIILEPCGKNTAPAIALAAFSALKRDKNKDPILLVLAADHIIKNEEAFCEAIKSAMFMAEEDKIVTFGIIPTYAETGYGYINIGARVESNIEVDNAHFYVAKKFVEKPERELAEKYFSSKKYLWNSGMFMFKASVFLSELKKYRPDIFEVCEEAISASSKDLDFIRLPERMFEKCPSESIDFAVMENTKRCVVCPVDIGWSDVGSWQSLWELSDKSPSGDVCKGDTLTYNTKNNYIYSDSALVAAVGVENIVIVQTKDAVLVANKSEVQDVKKIVDLLKKNNRTEHVTHREVFRPWGKFDSIDQGDRYTVKKIVVKPGEGLSLRMHHHRSEHWIVLSGTAKVILEGTEKLITVNESIYIPLGASYSLENPGVIPLILIEVSSGDYLGEDDIVRQKERYKKKINHE

SEQ ID NO: 14241 - protein, 468 aa, Escherichia coli
MSKQQIGVIGMAVMGRNLALNIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 14242 - protein, 441 aa, Escherichia coli
MNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRMLGASLLCVDSHEMINIVKMVMDAGLPYSILRDQIFTHPSMSESLNDLFSLVK

SEQ ID NO: 14243 - protein, 360 aa, Rhizomucor miehei
AAADGSVDTPGYYDFDLEEYAIPVSIGTPGQDFLLLFDTGSSDTWVPHKGCTKSEGCVGSRFFDPSASSTFKATNYNLNITYGTGANGLYFEDSIAIGDITVTKQILAYVDNVRGPTAEQSPNADIFLDGLFGAAYPDNTAMEAEYGSTYNTVHVNLYKQGLISSPLFSVYMNTNSGTGEVVFGGVNNTLLGGDIAYTDVMSRYGGYYFWDAPVTGITVDGSAAVRFSRPQAFTIDTGTNFFIMPSSAASKIVKAALPDATETQQGWVVPCASYQNSKSTISIVMQKSGSSSDTIEISVPVSKMLLPVDQSNETCMFIILPDGGNQYIVGNLFLRFFVNVYDFGNNRIGFAPLASAYENE

SEQ ID NO: 14244 - protein, 380 aa, Neurospora crassa
MASTVGKTITCKAAIAWGAGQELSYEDVEVAPPKAHEVRIQIKHTGVCHTDAYTLSGKDPEGAFPVILGHEGAGIVESVGEGVTNVKPGDHVIALYTPECKECKFCKSGKTNLCGKIRATQGRGVMPDGTSRFRARGQDILHFMGTSTFSQYTVVADISVVAVNPEAPMDRTCLLGCGITTGYGAATITANVEKGSTVAIFGAGCVGLSVIQGAVANGASKIIAVDVNPSKEEWSRKFGATDFVNPSTLPEGQSVVDKLIELTDGGCDYTFDCTGNVKVMRAALEACHKGWGQSIIIGVAAAGQEISTRPFMLVTGRVWRGSAFGGVKGRSQLPGLVEDYLNGKIKVDELITHRKKLAEINNAFEVMHQGDCVRAVVDMS

SEQ ID NO: 14245 - protein, 193 aa, Daucus carota
MKLSKSTLVFSALLVILAAASAAPANQFIKTSCTLTTYPAVCEQSLSAYAKTIQNNPQELASTALQVSLTRTQQAQTFMKRLNKFKGLKARQYAAIHDCLEEVEDSLDRVSRSCDEMKNLSHAKGNDFTFRMSNVETWVSAALTDETTCMDGFAGKGMDGKIKESVRAQVVAVARVTSNALALVNNFAAKHKH

SEQ ID NO: 14246 - protein, 467 aa, Escherichia coli
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 14247 - protein, 1466 aa, Emericella nidulans
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQQGLSTPSGGIPLQKSDRPRAQTAALQLQPTVGSVLTAPLRSRVCCDTGEYEPRRILHGFDGVMKTGELLLVLGRPGTGCSTFLKAVCGETNGLHIDADSVLHYNGVSQQRMMKEFKGEVVYNQEVDKHFPHLTVRQTLEFGAAARTPAHRFQNMSRDEFASYAASVVMAIFGLSHTHNTKVGNDFVRGVSGGERKRVSIAEMALAMTPFAAWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTGVRDQHPTGNDEQASAELRARKENSQSRNSRAASPYILSIPMQIKLNTKRAYQRIWNDMSSTMSTVVGQIVIALITGVVFYDSPNTTAGFQSKGGTLFYAVLLNALTAMSEITSLYSQRPIVEKQASYAFYHPATEAIAGVVSDVPVKFLLAVAFNVIMYFLANLRREPAQFFIYFLMSFTVMFVMSAVFRTMAAVTKNAAQAMGLAGVLMLALVVYTGYVLPVPSMHPWFEWIHYLNPIYYAFEAMIANEFHGRDFDCIAFVPSMQIWTGDSFSCSSLGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNPILPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFCRACCGTPGEGLNVEQRKLLTIGVELPPSPKLLLFLDEPTSGLDSQSSWAICTFLRKLADSGQAVLCTIHQPSAILFQEFDQLLFLAKGGKTVYFGPIGPNSRTLLDYFESNGARKCDEAENPAEYMIEVVNAEVNDHGTDWFDVWKGSKECQAVKEEIERIHEKKRGTAGAIEETDDGSTKSEFADAILVPAVCRHVRVFQQYWRMPEYIISKGALAIVAGLFIGFSFYDAKTSLAGLQTLVFSLFMVCALFAPLVNQIMPLFITQRSLYEVRERPSKAIPGKLPDCNILVEIPYQVLMGILTFVCYYYPLSVPAKDQTERALVLLFCIQFYVYASTFAHMCIAAMPNAETASPIVILLFSMCLTFCGVMQPPDALPGFWIFMYRVSPFTYWVAGMATTQVHGREVVCGENELSIFDPPTNQTCGQYMERYISVAGGQVLNPSATAGCEYCSLTVADEYLAASQIYWSDRWRNFGLIWVYIGFNIFVATAVYYLFRVKKWNGRRKK

SEQ ID NO: 14248 - protein, 1426 aa, Emericella nidulans
MSTLTVGDTALPRESRETMVSIQGIRIVNYSSRRGFRFHNKIQMSAVPMAGLLMPQVKEQNEREAESGFKRRELGVTWQNLSVEVVSADAAVQENFLSQFNVPKLARESRNKPPLRTILDNSHGCVKPGEMLLVLGRPGSGCTTLLKMLANQRLGYKAVQGDVRYGSMTAKEAEQYRGQIVMNTQEELFFPSLTVGETMDFATRLKVPNRLPNGVESPEAYREEYKKFLLQSMGISHTVDTKVGNEFIRGVSGGERKRVSIIECLGTRASVFCWDNSTRGLDASTALEWTKTIRTMTDVLGLSTIVTLYQAGNGIYDLFDKVLVLDEAKQIYYGPMTQARPYMETLDFVCREGSNVADFLTGVTVPTERKIRSGFEARFPRNADAMLEEYNKSAVKADMISEYDYPDSEYAKLRTEDFKQAIAEEKAKQLPKSSPFTVDFMNQVKICVTRQYQILWGDKATFIIKQVSTLIQALIAGSLFYDAPNNSGGLFVKSGALFFSLLYNSLLAMAEVTESFQGRPVLIKHKSFAFFHPAAFCIAQIAADIPVLIFQVTIFALPVYFMVGLEMDAGVFFTYWILVFATTMAMTAVFRACGAAFKTFDDASKVSGFLISALIMYTGYMIRKPEMHPWFVWIYWIDPLAYGFDALLSNEFHGKIIPCVGTNLVPAGPGYENATTQSCTGVGGSIPGRNYVTGDDYLASLSYSHGHVWRNFGILWAWWALFVVVTIIATSRWKGASENGPSLLIPRESVEKHRQHGHRDEESQSNEKTSTKGKSEGVQDSSDIDNQLVRNTSVFTWKDLCYTVKTPSGDRQLLDHVYGWVKPGMLGALMGSSGAGKTTLLDVLAQRKTAGTIQGSVLVDGRPLPVSFQRSAGYCEQFDVHEPYATVREALEFSALLRQPRTTPREEKLKYVDVIIDLLELHDIADTLIGRVGAGLSVEQRKRVTIGVELVSKPSILIFLDEPTSGLDGQSAYNTVRFLRKLADVGQAVLVTIHQPSAQLFGEFDSLLLLAKGGKMVYFGDIGDNGSTVKEYFGRHGAPCPPNANPGEHMIDVVSGSLSQGRDWHEVWKASPEHTNAQKELDRIISEAGSKPPGTVDDGHEFAMPLWQQTVIVTKRTCLGVYRNTDYVNNKLALHIGSALFNGFSFWKMGASVGELQFKLFVLFNFIFAAPGGIGQVQALFIERRDIYDAREKKSRIFSWVGFVTGLIVSELPYLVLCAVLYFVCFYYQTGLPTSSDKAGAVFFVMLLYEGLYTGIGQFISAYAPNAVFATLTNPLVIGTLVSFCGVLVPYGQIQEFWRYWIYWLNPFNYLMGSLLTFTIFDVDIKCRESEFATFDPPNGSSCIDYLSTIFKGWGVSANLINPDATSQCQVCQYTRGSDYLYSLNLKDYYYGWRDTAIVALFVLSSYALVYGLMKLRTKASKKAEE

SEQ ID NO: 14249 - protein, 466 aa, Cortusa matthioli
KAGAGFKAGVKDYKLTYYTPDYDPADTDILAAFRVTPQPGVPPEEAGAAVAAESSTGTWTTVWTDGLTNLDRYKGRCYSIEPVAGEETQYFAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMD

SEQ ID NO: 14250 - protein, 157 aa, Daucus carota
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 14251 - protein, 442 aa, Leptospira meyeri
MVGPSGESMPRNFKPETIALHGGQEPDPTTTSRAVPLYQTTSYVFKDTDHAARLFGLQEFGNIYTRLMNPTTDVLEKRVAALEGGVAALATASGQSAEMLALLNIVEAGQEIVASSSLYGGTYNLLHYTFPKLGIKVHFVDQSDPENFRKASNDKTRAFYAETLGNPKLDTLDIAAVSKVAKEVGVPLVIDNTMPSPYLVNPLKHGADIVVHSLTKFLGGHGTSIGGIIIDGGSFNWGNGKFKNFTEPDPSYHGLKFWEVFGKFEPFGGVNIAFILKARVQGLRDLGPAISPFNAWQILQGVETLPLRMERHSGNALKVAEFLQKHPKIEWVNYPGLSTDKNYATAKKYHERGLFGAIVGFEIKGGVEKAKKFIDGLELFSLLANIGDAKSLAIHPASTTHQQLTGPEQISAGVTPGFVRLSVGLENIDDILVDLEEALKNI

SEQ ID NO: 14252 - protein, 294 aa, Sesbania rostrata
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 14253 - protein, 469 aa, Sinojackia rehderiana
KASVGFKAGVKDYKLTYYTPEYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAIFARELGVPIVMHDYLTGGFTANTSLAHYCRDNGLLLHIHRAMHAVIDRQKNHGIHFRVLAKALRLSGGDHIHAGTVVGKLEGEREITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFDFEAMDILV

SEQ ID NO: 14254 - protein, 487 aa, Neurospora crassa
MSAKSILEADGKAILNYHLTRAPVIKPSTLPNPTKHNPPPRLASLHFAEDADVNGVLSQAEVTYPWLLQEGARFVAKPDQLIKRRGKSGLLALNKTWAEAKAWIAERAGKPQKVEHTEGVLRQFLVEPFVPHPQETEYYININSVRDGDWILFYHEGGVDVGDVDAKAEKILIPVDLSQYPSNEELASTLLKHVPKGIHNVLVDFIARLYAVYVDCQFTYLEINPLVVIPNEDATSAEVHFLDLAAKLDQTADFECGNKWAIARSPAALGIVAQSSNTGVNIDAGPPIEFPAPFGRELSKEEAYIAELDAKTGASLKLTVLNPNGRIWTLVAGGGASVVYADAIASAGFADELANYGEYSGAPTESQTYHYARTVLDLMLRAPVSEKGKVLFIGGGIANFTNVASTFKGVIKALREYGKALIEHNTQIWVRRAGPNYQEGLKNLKAATQELGLNAKIFGPEMHVSGIVPLALVPGKWEESGAVEFQA

SEQ ID NO: 14255 - protein, 405 aa, Neurospora crassa
MSWKMSEKLMDTIRHYASFPATGVSLRQMVQFGEKPSTGTLFRASQFLAEELPIRLAHRVQELDNLPDGLNEMPSVKKVQAWYAQSFEATPNPSIEEGQYASHNGASYASGLNHKKFSASRRYFAMVDDTGDWPPDLHLYNQKFAQTLHKIKRRHDSVVTTMAQGILEYKRKRQRMQIDHNIQSFLDRFYMSRIGIRMLIGQHIALTDQNHYRDPSYVGIICTKTYVKDLAQEAIENARFVCEDHYGLFEAPKIQLVCNPNLNFMYVPGHLSHMLFETLKNSLRAVVETHGQDKQEFPVTKVIVAEGKEDITIKISDEGGGIPRSAIPLVWTYMYTTVDRTPNLDPDFDKSDFKAPMAGFGYGLPISRLYARYFGGDLKLISMEGYGTDVYLHLNRLSSSSEPLQ

SEQ ID NO: 14256 - protein, 333 aa, Neurospora crassa
MQSILQKATGIGPKPVQPTDLNGRVAVVTGGAFGIGFEVSRALANAGCRVIMVNRKEEQGDDAKATITAETPGAVVEWRECDMGNLSQVRSVFSELREQLDRLDFLVLSAGINTNQYGLDADGIDRHFGVNYLGQYYVVNQLYPVLKKTSKLPNTPAPRVVFEASEMHRAAPSAVHFASLDEINNPDLGPTELYGRTKLAMILFAKYGLAEKVIKKNGDNIYAASVHPGAVNTAMQQQWKDAYPGITGKLLTWATLAFGRDVKQGSYSALWALTDPKIEEQNLNGWYFSDPDQPGKETSQASDPVLGQALWDLSERIIKDKLGEDALVDWYSA

SEQ ID NO: 14257 - protein, 433 aa, Neurospora crassa
MTDHDDKISSFCELTGVATDAATEYLNNYDWDMDAAVAAYYTDQDNSASNTGAAPASARASAAAPPEYIGPRTLDGRPAPQYAQSSSSAPKKTQKRTGLATLSSIGGRRDEDDDEDEDDEEDEGRGPRDLFAGGEKSGLAVQDPSQREPNSDTRRLLQDILAKARENSRAGGNSSDDEETGAETGAGTARPTRFRGTGMTLGGDGVESRQIPNVDSNTSAAPRQLEGPTQERTLHIWSNGFSVEEGPLYRFDDPANQADLAMIRAGRAPLRLMNVRPDQRVNVKLEQHQEEWRQLPKKYVPFSGEGRRLGSPVPGDGSGFVPPAAAAAASTAVASASATSGSAQAPTTGVDESQPTVMLRIQLPDGSRLPARFNTSQTIGDVYDFVQRSSTSLSARPWVLSTTFPNKDHTDKSLVLGDTPEFKRGAAAVVKWV

SEQ ID NO: 14258 - protein, 1032 aa, Neurospora crassa
MADIKIDSKVFQERVSHFYNAWKADKRSGDALFGGVSSIVILMGKVDENPEFHKNNAIHFWLLGYEFPTTLMLFTLDTIYILTTQKKAKYLDQVKGGRYPVEVLVRGKDAAENEKLFIKITDAIKAAGKKVGVLTKDTSKGPFIDEWKKVYADNCKDVEEVDVAQALSAGAFSVKDETELRAMRTSSKACVALLTPYFLDEMSNILDQDKKIKHSALADKVFNKLEDDKFWKTVELPNRQKLPADLDPEQLDWILGPIVQSGGKFDLKWQADSDNDILHPGIIIAAMGLRYKSYCSQIARTFMVDPNKSQESNYKFLLAVHNLILKEIRDGAIVKDVYTKAYNFVRSKKPDLEKHFLKNVGFGIGLENKDPTLILNNKNTRTLKDGMTLVVTTGFSDIQNPNPQDKNSKVYSLILSDTIRVTSSEPVVFTGEAPVDVDATSFFFKDEEEAQPTPKKEKRDSRVGAVATKNITSTRLRSERNTTVDEDADKRRREHQKELAQKKQKEGLAKYAESTADENGVEIKKFKRFESYKRDNQFPPKVKDMGIVIDQKNATIVLPVMGRPVPFHINTIKNASKSDEGEWSFLRINFLSPGQGVGRKDEQPFEDASAHFVRSLTFKSTDGDRYADIANQISNLKRDAVKKEQEKKDMEDVVEQDKLVEIRNRRPAVLDNVFIRPAMEGKRVPGKVEIHQNGIRYQSPLSTTQRVDILFSNVRHLFFQPCQHELIVIIHIHLKDPIIIGNKKKTKDVQFYREATDIQFDETGNRKRKYRYGDEDEFEAEQEERRRRAELDRLFKSFAEKIAEAGRNEGIEVDMPLRDLGFNGVPFRSNVYIQPTTECLIQITEPPFMVITLEDIEVAHLERVQFGLKNFDLVFVFKDFTRPPYHINTIPVESLEDVKEFLDSSDIAFSEGPLNLNWGVIMKTVTANTHQFFLDGGWGFLQNDSDDDEVEEEEEESAFEIDESELEDASESSEEDSEYDSNASEEASDEAEDSEEEEGEDWDELERKAKKRDRESGFDDEEERAAPKKRRK

SEQ ID NO: 14259 - protein, 251 aa, Neurospora crassa
MTEGPAYSKKVVVVGDGGCGKTCLLISYSQGYFPEKYVPTVFENYITYPTHPPTGKTVELALWDTAGQEEYDRLRPLSYPETDLIFVCFAIDCPNSLENVMDKWYPEVLHFCPYTPLILVGLKSDLRNKKTCIDMLKTQGLTPVTTEQGLAVAKKMGAQYMECSSKEMKGVEEIFEQAILTVVANDRKTLEQEAANGMLGVGAGSGSGKGSGISFSSGDKAGSGIGPVKAAGVGGTIVPKTRKKKRKCGMM

SEQ ID NO: 14260 - protein, 494 aa, Neurospora crassa
MSSNVFVELKTPVTGTYKQPTGLFINNEFVEGVDKKTFEVINPATEEVICSVHEATEKDVDIAVAAARKAFEGVWRDVTPQQRGIYLLKLADLLEKNLDLLAAVESLDNGKSITMARGDVGAVVGTIRYYGGWADKIEGKTIDISPDSFHYTRQEPLGVCGQIIPWNFPLLMLAWKVGPALATGNTIVMKTAEQTPLSALVFAQFVKEAGFPPGVLNIISGFGRIAGAAMASHMDIDKVAFTGSTMVGRQIMKAAAESNLKKVTLELGGKSPNIIFNDADIDQAIDWVNFGIYFNHGQTCCAGSRVYVQEGIYDKFVAAFKQRAQQNKVGDPFHDETFQGPQVSQLQYDRIMGYIKAGKEEGATVETGGERHGDKGYFIQPTIFTNVRHDMKIMKEEIFGPVCAVAKFSTEEEVIKLGNDSNYGLAAAVHTKDLNTAIRVSNHLRAGTVWVNTYNALHHQLPFGGYKESGIGRELGEAALANYTQCKSVAIKLN

SEQ ID NO: 14261 - protein, 247 aa, Arabidopsis thaliana
MVILSASSTVRAALDTQPRLPYNPNAPRKVKKIPNGNSFLPPPSPAPSPGISISVADLLKRPSSKEITVDVDDTYMGYETWSPSPPKLEKPRSVFNPASLAFIGDSIYELYARRHFLFPPLSIEDYNDRVRAVVRCEAQYALLNKLVDDDFLTKEERDILRWGKNLGSARTRTRRRAGNAVYNKASSLETLIGYLYLTNGKRLEKIMEKLGFSSDSSTEIVIEETNPKPSESSNLPNFILNEQVVSF

SEQ ID NO: 14262 - protein, 462 aa, Arabidopsis thaliana
MWRRSNLPGNPDSDQSISEEEEENDISPKENAKEQERGLLLQTKLEKLIGCGELNYARETGDVTLEATLRKISSSLEDVVEVPDSPEESYISSSRRTGLACISAQENGSDDEITHDEQVATWSAISKETKSLIHLNGVASVASSHLSGFRAKKSSNGLKDHGRPKFSFNSHTHGETSSKISDMAEIFEPDVEDQAIEEDPIIECPNSFDERSENRQGVSVAESREVLHECTKDAVPKLQEIPLDKIRLIKRSSELDSRHEAKSRKFTHKGNSSNFQDSDTDDELPGPMDSGSSSDDEPSYQSSVPNISNQKKQFVGDRFDEAIKASSLSKEGLLFGSPKLSGGSSLYGKLQQIMKQEKETEMEIMRKLQSGIGEAVMSRHLEGKLVVCKCSVIDLSGDSLLLKNTQALAAKETETTIIFSPKVCADVDIEIGNFIRVYAPWKELEVQKTNDVIILSSYFSSL

SEQ ID NO: 14263 - protein, 284 aa, Ricinus communis
AIAQLGWVAGPVILMAFSFITFFTSTLLADSYRSPDPVTGKRNYTYMDAVRANLGGWKVTFCGISQYANLVGITVGYTITASISMVAVKRSNCFHRHGHAAKCHTSNNPYMIIFACIQIILSQIPNFHKLSWLSVLAAVMSFAYSSIGLGLSIAKVAGGEHVRTSITGTTVGVDVTAAQKIWRAFQSIGDIAFAYAYSTVLIEIQDTIKSGPPENKAMKKASFVGIVTTTMFYILCGCIGYAAFGNDAPGNFLTGFGFYEPFWLIDIANVCIAIHLIGAYQVFS

SEQ ID NO: 14264 - protein, 403 aa, Arabidopsis thaliana; identical to SEQ ID NO: 527

SEQ ID NO: 14265 - protein, 458 aa, Burkholderia cepacia
MKGKSSTRLVLRLSTLAALAVQASAQAATCTPQWSSSASTNTTNLQNAIQQCAASGTSSSPGLVDLASNNGISTAVITSVNLANNIVLKLEKGFTLKGSPAQPSSGAMLTGSNLSNLTITGTGAIDGDGQDYWPAAVGQNNTARPKLIAITGSNLQIGSNFTDAGKSQSIVAFPSSSNATGSALIIRNSPKEQLVIESGSKNVTIDGVWIYANPNRNASGDDLAPNTDAIDIIGTQTATIKNCLLDTGDDDIAIKSNAGGAATSSVNVSHCVVGGGHGISIGGQEAAGTTLAKPGVSQVTVDTMQFSGTDYGYRIKTDQTAKDSGATTGVTYRNTCMRNVQQPFLFTYAYASGTGGALPIIANVTIDNVIATATKQQGAIIGLSNSLMGVPKSGDTGISITNSQISGGKAFSVTDGELQLGSHSSATTSTGSNGQVVGIPDTGATLSCPSSITIPAQI

SEQ ID NO: 14266 - protein, 141 aa, Arabidopsis thaliana
MMNTKKLIKMAKKWQQRAALHRKRISFQRSSSATSSTAAEKGCFVVYTTDSTRFAFPLSYLSNSVFQELLKISEEEFGLPTGGPITSPFDSVFLEYLIKLVQRRMDADTEKALLMSISSARCSSQCSLKLQERSTQQLLVF

SEQ ID NO: 14267 - protein, 148 aa, Arabidopsis thaliana
MINTKKLLKMAKKWQQRAALKRKRISFQRSTTTTTTTTTTTSSSTAVEKGCFVVYTVDKIRFAFPLSYLNNSVFEELLKISEEEFGLRAGGPITLPFDSVFLEYLIKFIERRMDGDTEKALLMSISSARCSMQPQEQQSGYTQQLLVF

SEQ ID NO: 14268 - protein, 102 aa, Arabidopsis thaliana
MMNTKKLMKMAKKWQQRAALRRKRISFQRSNSTTSSSSAVEKGCFVVYTADQVRFAFPISYLSNSVIQELLKISEEEFGIPTEGPITLPFDSIRFSWSISSN

SEQ ID NO: 14269 - protein, 143 aa, Arabidopsis thaliana
MMINAKKLMKMAKKWQQRAALHRKRISFQRSNVFTSSSSTVEKGCFVVYTADKIRFAFPISYLSNSIVQELLKISEEEFGLPTEGPITLPFDSVFLEYLIKLIQRRMDGDTEKALLMSISSAKCSLQCSLLQQEQSTQQLLVL

SEQ ID NO: 14270 - protein, 394 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 14271 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPIYHFLGTSTFSEYTVVHVGCVAKINPLAPLDKVCVLSCGISTGLGATLNVAKPTKGSTVAVFGLGAVGLAAAEGARIAGASRIIGVDLNPKRYEGAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLKGEGLRCIIHMEP

SEQ ID NO: 14272 - protein, 333 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYTSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQVAIFEQGELKAIHWSADAVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 14273 - protein, 453 aa, Arabidopsis thaliana
MEQGESLRIRVVMGKDRISELPDALLIKILSFLPTKIVVATSVFSKQWRPLWKLVPNLEFDSEDYDDKEQYTFSEIVCKSFLSHKAPVLESFRLEFESEKVDPVDIGLWVGIAFSRHLRELVLVAADTGTGTAFKFPSSLCTCNTLETLRLVLLILVDISSPVVMKSLRTLHLELVSYKDESSIRNLLSGCPILEELLVIRGEDSDIEVFTIDEVPSLKRLTINDDHDGQEFWGYVINAPSLKYLLIEDLRCPGFCLNAPELMEANIFDGTSITNDNFLGYLTSVKRLLLNLSPWKITYPTGSIFYQLVSLEMYTREIDWWDLLTLMLEHSPKLQVLKLTDNCVKFHKNGLPGGKWNEPKYVPECLLSHLETFVWRRFDWGREEEKEIATYILKNARRLNKATFSTNPVNSEELDKLKERRKVHNELDGVVRASNSCQFVFKFDTSYHVSDSS

SEQ ID NO: 14274 - protein, 459 aa, Brassica rapa
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVKKSCPSRNGTCDDSSWLDFLRKIQERSGLGDETHGPEGLLQVPPRKTFAAAREETEQVIIGALENLFKNTNVNPKDIGILVVKSSMFNPTPSLSAMVKNNFKLRSNVRSFNLGGMGCSAGVIAIDLAKDLLHVHKNTYAFVVSTENITYNIYAGDNRSMMVSNCLFRVGGAAILLSNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 14275 - protein, 458 aa, Brassica rapa
MTSINVKLLYHYVITNLFNLCFFPLTAIVAGKAYRLTIDDLHHLYYAYLQHNLITIAPLFAFTVFGSVLYIATRPKPVYLVEYSCYLPPTHCRSSISKVMDIFYQVRKADPSRIGTCDDSSWLDFLRKIQERSGLGDENHGPEGLLQVPPRKTFAAAREETEQVIIGALENLFKNTNVSPKDIGILVVHSSMFNPTPSLSAMVNNFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDYSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 14276 - protein, 459 aa, Brassica oleracea var. alboglabra
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALGNLFKNTNVSPKDIGILVVNSSMFNPIPSLSAMVVNTFKLRSNVRSFNLGGMGCSAGVIAIDLAKDLLHVHKNTYALVVSTENITYNIYAGDNRSMMVSNCLFRVGGAAILLSIKPGDRRRSKYELVHTVRTHTGADDFSFRCVQQGDDENGKTGVSLSKDITDVAGRTVKKNIATWGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 14277 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 14278 - protein, 492 aa, Pseudomonas putida
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALVEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAGDVTILPHNLSEALEVLETSKFFREAFGEEFIRYWMHLRRSEWKRFVDAEGQVDFSGDPVTNWEHREYFELF

SEQ ID NO: 14279 - protein, 448 aa, Halomonas halodenitrificans
MQHLEGVTRPQQYRALGLSTLAFTTCFAVWTIFSIIGIQIKQDLGLNETQFGILVATPILTGSISRIFLGIWTEQFGGHRVFSVLMLLTAACVFLLSYVESYAMFLVAALGIGLAGGAFIVGIAYTSYWFEKDKQGTALGIFGAGNAGAAVTNFGAPFLLLALGWERTAVVYAVVLAAVAVGFWVFATEDPLTRARRRGQGAQATSARAQLEPLRHLRVWRFALYYFFVFGAFVALASYLPRYYVGAYGVSIAVAGSLAALYTLPASVFRALGGWMADRYGARAVMYLTFIASLVCLFLLAYPETRYVVQGKEGEIAFTLAMPLWGVVVLTVLLGFFMSLGKAAVFKHIPVYYPENVGSVGGLVGMIGGLGGFFLPILFGIVLDLTGIWTSSYMVIFMLVAVSLIWMHTAIRRMERKNVPELGEERYRYLPEIQEPAEEHARRHGPRP

SEQ ID NO: 14280 - protein, 459 aa, Arabidopsis thaliana
MEEDRESRVSAKPSGDRVDRLRNLPDCLLFKILLNLPTKDVVKLSVLSRRWRNVWRYVPGLDLECGDFMVREYYDSSEFNALLGFVYRFLGFNSESCLQKFKLTVNWYDDVQLETVHFTEWFNAVVKRKVQHLHILDKTWGRDEVVIPPTVFTCGSLISLNLYDVYLPNREFVSLPSLKVIVLDAVVFDEDFAFEMLVSGCPVLESLSVNKINLNDISESVQVSSQSLLSFSYVADDDDYLEVVIDAPRLHYLKLNDKRTASFIMKNHGSLLKADIDFVFNLGSEYMFDPNYLPTRHIIRDFLVGLSGVKDMIISSSTLQVIYDYSRCEQLPLFRNVSFLRVEFADYRWEMLPIFLESCPNLKSLVLGFSIPPGKEGANILPGPRRFLTSLEYVKIAKPMAAEASEIKLKLVSYFLENSTILKKLTLCLRNFREKEESVIVKKLLTIPRLSPSCQVFVL

SEQ ID NO: 14281 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 14282 - protein, 299 aa, Arabidopsis thaliana
MIPYATIEEASIALSRNLTWLETLWFDYSATKSDYYLYCHNILFLFLIFSLVPLPLVFIESSQSTSDLFNRYKIQPKVKNSFSSMFKCYKDVMKMFILVVGPLQLVSYPSIQMIEIRSGLPLPSCMEIVAQLVVYFLVEDYTNYWVHRFFHCKWGYEKFHHIHHEYTAPIGYAAPYAHWAEVLLLGIPTFLGPAIAPGHMITFWLWIALRQIEAIETHSGYDFPWSLTKYIPFYGGAEYHDYHHYVGGQSQSNFASVFTYCDYIYGTDKGYRFQKKLLQQMKEKSKKSNKLVNGGEKFD

SEQ ID NO: 14283 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 14284 - protein, 161 aa, Narcissus pseudonarcissus
LKKGSSTDQDVEVYRGEEFDDDGRPRRTGTVWTASAHIITAVIGSGVLSLAWSMSQLGWIAGSVTLFLFSIVTFFTSSLLTDCYRSPDPVHGKRNYTYMSAVKSNLGSTKVWFCGICQYVILVGTAIGYTITASISAAAISKSGCFHKKGHEADCAVSDSL

SEQ ID NO: 14285 - protein, 154 aa, Narcissus pseudonarcissus
KVMKKASFIGVSTTTTFYLLCGCLGYAAFGNKAPGNILTGFGFYEPFWLVDIANLCIIIHLVGAYQVFSQPIFSAVETWITNRHPNINFLNHDRVLVIGKCFRYKINLFRLIWRTLFVIACTFIAILMPFFNDILGFLGAVGFWPLTVYFPTEM

SEQ ID NO: 14286 - protein, 143 aa, Narcissus pseudonarcissus
ASLAWAVMPTLGWRWLLALSALPPFLLLLFYGLAPESPRYLSMKGRTDDAVRVLERMASINRKPLPHGQLVSRCKSDLAEKLNPSETAHLILTQNRSTDDEDAVSQVGCIFVVRRILSPALIKATLLLWIDFFGNAFAYYGVV

SEQ ID NO: 14287 - protein, 167 aa, Mesembryanthemum crystallinum
QSIDIDGKKVKAQIWDTAGQERFRAVTSAYYRGAVGALVVYDITRRTTFDSISRWLDELKTHSDTTVARMLVGNKCDLDDIRAVSTDEGKSLAEEHGLFFIETSAKDSTNVKTSFEIVIKEIYCSVSRKVLNSDSYKAELSVNRVSLVNDDKQKQNQGYISSSCCSG

SEQ ID NO: 14288 - protein, 496 aa, Nicotiana plumbaginifolia
MAGNGVFVDIIEGDVFKYYSEGEWKKSASGKSVAIINPTTRKTQYKVQACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTMHPGVHCISFTGGDTGVAISKKAGMIPLQMELGGKDACIVLEDADLDLAAGSIVKGGFSYSGQRCTAVKVVLVMESVADALVEKVNAKVAKLTVGPPEDDCDITPVVSESSANFIEGLVMDAKQKNATFCQQYKREGNLIWPLLLDNVRPDMRIAWEEPFGPVLPVIRINSVEEGIHHCNASNFGLQGCVFTKDINKAILISDAMETGTVQINSAPARGPDHFPFQGIKDSGIGSQGITNSINMMTKVKTTVINLPTPSYTMG

SEQ ID NO: 14289 - protein, 407 aa, Fusarium venenatum
MPSLNALLAASLAFASIALGAPAVQDKHFSVEQVKNPKFIKSGPLALAHVYSKYGVPLPKGLEKAVKAVKSSSHSKRQNGSGSVITTPADEDIEWLTPVQIGTPAQTLNLDFDTGSSDLWVFSTETSGSSGHDEYNPAKSSTSKKLAGATWSISYGDGSTSSGDVYKDKVSVGGLAVASQAVESAQRVSDEFEQETGLDGLLGLGFSSINTVKPTKQKTFFDNAISTLQSPVFSADLKHQQPGTYNFGYIDSSAYTGKIGYAPIDSSGGWWEFTSSGYAVGSAALNKSPITGIADTGTTLLLLPDAVNSAYYAKVSGARYSSSYGGYVFSCSATLPNFSFAVGGVTITIPGSYINYAPVQQGSSTCLGGIQPSDDIGINIFGDIALKAAFVVFDGGNQQVGWAKKTL

SEQ ID NO: 14290 - protein, 183 aa, Vicia faba
CDASGTMGGACGYGNLYSQGYGTNTAALSTALFNNGLSCGSCYEMRCNDDPRWCKPGSIIVTATNFCPPNPAQANNDGGWCNPPLQHFDMAEPAFLQIAEYRAGIVPVSFRRVPCFKKGGVRFTINGHSYFDLVLVTNVGGAGDVHSISIKGSRTSWQPMSRNWGQNWQSNSYLNGQSLLCGW

SEQ ID NO: 14291 - protein, 454 aa, Listeria innocua Clip11262
MKYVIVGTSHAGFEAVQTLLKKDSDAEIVVFEAGSTASFLSCGIQSYLEDISKSLDELHYANEASYKEQGVDIRMNTSVIAINPETKEITTRTTDGVEATESYDKLLLSPGGVPGTIPNVDDQHENIFYLRGRNWADKVKNRMSSAKKAVVVGAGYIGIEAAIAYAQAGIDVTVVDFVDSILPTYLDSEFTSLLTKHMEEKGMKIKTGEGVKEFKVNENNEVTAVVTDKGTYEADTVIISVGVRPNTQWLKDTLTLDGRGFVEVNEHMETSVKDVYAAGDATAIPFAPTNDKAYIALATNARRQGVIMARHASGDADAKIGRVNGTSGLAVFDYKFATTGIKDANANSYQGNVKSVYKEDLIRPSFMHDEEKVLMKLHYDADNGRILGAQLMSTYDILQAINAVSVAIEAEWTVDQLAQADFFFQPEFSRPWNFLNVLAQEAQGQPYGADTMLF

SEQ ID NO: 14292 - protein, 380 aa, Fragaria x ananassa
MSSTEGKVICCRAAVAWEAGKPLVIEEVEVAPPQANVVRVKILYTSLCHTDVYFWEAKGQNPLFPRIYGHEAGGIVESVGEGVTDLKAGDHVLPVFTGECKECDHCKSEESNMCDLLRINTDRGVMLNDGKSRFSIKGKPIYHFVGTSTFSVYTVTHVGCLAKINPQSPLDKVCILSCGISTGLGATLNVRKPKKGSTVAVFGLGAVGLAAAEGARMAGASRIIGVDLNSNRFEEAKKFGITEFVNPKDHKKPVQEVIAELTNGGVDRSIECTGNIQAMIPAFECVHDGWGVAVLVGVPHKDAVFTTHPMNFLNERTLKGTFFGNYKPRTDIPSVVEKYMNKELEVDKFITHQLPFSQINKAFDYMLKGEGIRCIITMEE

SEQ ID NO: 14293 - protein, 344 aa, Enterococcus casseliflavus
ATAFENDWVKASGLPQEATGFKVAIVGSGPAGLSAAWRLNQLGHQVTVYERSDRFGGLLMYGIPNMKLDKDVVQRRIDLMAELGVTFVANTEIGRDLSAEELAAQYDRVILATGASVPRDLKIPGRELTGVQFAVDYLTEATKDVLKHGKAATSKKLAGKHVIVIGGGDTGNDCIGSAIRQGAASVRQLEITPQLPLTRTDSNPWPEYPMTARTGYGQEEAAEVLQTQVTYHGVSTTAFIGAERGQLIAIETVSVDQQFQPIPGTEQVIKADLVLLAMGFVGAETQLFDAFGVREVYDDYTTNNERVLVAGDAKRGPSLVIWAIREGRLAAEKVDQALRSLVYQ

SEQ ID NO: 14294 - protein, 413 aa, Lycopersicon esculentum
MQLKSVNTFAITIMLGFTLIILFFSGFLDFPLHTSSSIPSTKNQILTTISVSEPDPFSNLLSTFKKWDSQVGCAKFRGEHKGLLGNGLLLDSSSGSLQNVDDGELKCNELKMDHVSVLVKGWTWIPDNLDNLYSCRCGLSCLWTKSSVVADKPDALLFETATPPVERRRGDPLRVYMDLEAGRKKSGYEDIFIGYHAEDDVQSTYAGALFHNNRNYHLSPYKNNDTLVYWSSSRCLPQRNQLAKRLLSLLPSHSFGKCLNNVGGLDKALSFYPECIKDSNEAPKWWDHLHCAMSHYKFVLAIENTKTESYVTEKLFYALDSGAVPIYFGAPNVWDFVPPHSIIDGSKFSSLEELASYVKAIANNPVAYAEYHAWRRCGVLGNYRKTRAASLDTLPCRLCEAISKRNGRNAKAS

SEQ ID NO: 14295 - protein, 367 aa, Monascus purpureus
MAEPQIPTKQKAAIYDKPGTVSTKVVEIDVPEPGPGEVLVNLTHSGICHSDYGVMTNSWKLLPYPTQPGQIGGHEGVGKVVKFGPGANGTGLKIGDRVGIKWVSSACGNCHPCHAGADGICLNQKISGYYTPGTFQQYATGPANYVTPIPENLSSAEAAPLLCAGVTVYAALKRSKAQPGQWIVISGADGGLGHLAVQIASRGMGLRVIGIDHGSKAALVKESGAEHFVDITAFPKDDNGAAIAAHVKSLTTEKLGAHAVIVCTASNAAYAQAFLFLRFNGTLVCVGMPEHESQAIATAYPAAIVFNQATITGSAVGNRIEAIEVLDFAARGIIKSHVRMAKLEDLTDLFNEMAEGKLQGRVVLDLS

SEQ ID NO: 14296 - protein, 450 aa, Saprolegnia parasitica
MVRLLPSLVAATLALVAAEVPVNVMLPLDTVVLDSKACSNTRLKNATTLSLQFEKLKASGATGVMADCWWGLVEGAGPRQYDFAAYADLARLAKASNLTIQMVMSFHQCGGNVGDECDIPIPRHWFTKDDVWYTTQAGLTTKEYISLWADATPLDKFGRTPLQMYSEFLAAFKTHVVDAYPGVVSEVQIGGGPAGELRYPSYQLQENRWSYCGVGEFTSYDSYANASIVAHAASTGHALWATRPGPSNAGTFNCLPSENGPCPFFANGADNFASPYGQFFLDWYSGSLLQHGRDLSKLGRDVFPAPFELSVKVSGIHWWYDSPHHGAELTAGYQNTNNKNAYYDIASMLKEHDVRFCFTCMEMNDNYDDNDKCRSRPSKLVGQARDAINALGLSLKHSFAGENALPIGGNDQITAIAGHIAGAASFTFLRLTDSFDFDYLGRLVQRLKTV

SEQ ID NO: 14297 - protein, 397 aa, Candida parapsilosis
MTIIAVFTGNFLAFIAFVVFAQGAAIPDPAKRDDNPGFVALDFEVTRKPVDVNSTLERAKRDSVSSPLYFEGPAYGIRISVGSNRQEQQVVLDTGSSDFWVIDANSSCTKEGTECKKYGTFDPDTSTSFNYLGFLFAIVFGDKTSSIGLWAEDTVQIGDITLTNQSFADVSLTSAIQGVMGLSRPQPDSPNARFDSVPVTLKKQGKIKTNAYSLYLNSPGAATGTIIFGGVDNAKYSGKLIEESVVSDQHFSINLQSLNYDGNKESAGVGVLLDSGSTISYLPDRIVADLAEKAGARAVPAGLTGDFYFIDCDAKPEGNATFTFDNGAEISVPLTEFVTQSTNEFCPWGLQSSDTSGGTPILGDNFLRHAYVVYNLEKDTISLAQVKYTSESSVSAI

SEQ ID NO: 14298 - protein, 355 aa, Gibberella zeae
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQVIMW

SEQ ID NO: 14299 - protein, 117 aa, Sorghum bicolor
PGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 14300 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 14301 - protein, 300 aa, Xanthobacter flavus
MAISKEADTLRALYQSWTDQMVANPNLTILNLRSMFDEWGRPALEPESVTYKSDCVGGVEAIWAYPQSADTSHVILYTHGGGFAVGSADSHRKMAGHLAKALGVTACNLHYRRAPEHPFPAQIEDAVAAYKALLAKGYDPKKIATAGDSAGGNLAVASVLKFRDLGLPLPGAVIAYSPWLDMALRGKTLQTNAGTDALVSQAILEGMRGMFLGGKTDPLDKLANPLENDFTGFPPLYITCGSAETLQSDSESLHAKAKAQGVKTVLSVVPGMQHVFPALSGRALEADQELARIAAWYRAL

SEQ ID NO: 14302 - protein, 475 aa, Orthothecium rufescens
  misc_feature (18)..(18): Xaa can be any naturally occurring amino acid
  misc_feature (444)..(444): Xaa can be any naturally occurring amino acid
MSPQTETKAGVGFKAGVXDYRLTYYTPDYQTKETDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEXIREATKWSPELAAACEVWKEIKFEFDTIDTI

SEQ ID NO: 14303 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADRLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 14304 - protein, 203 aa, Mycobacterium avium
MGVAQISSAITPAQPAELYPGDIKSVLLTAEQIQARIAELGREIGDNYRDAAAETGQDLLLITVLKGAVIFVTDLARAIPLPTQFEFMAVSSYGSSTSSSGVVRILKDLDRDIQGRDVLIVEDVVDSGLTLSWLLRNLSTRHPRSLRVCTLLRKPDARGAHVDIAYVGFDIPNDFVVGYGLDYDERYRDLSYIGTLDPRVYQQ

SEQ ID NO: 14305 - protein, 202 aa, Mycobacterium tuberculosis H37Rv
MHVTQSSSAITPGQTAELYPGDIKSVLLTAEQIQARIAELGEQIGNDYRELSATTGQDLLLITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPKTFVVGYGLDYDERYRDLSYIGTLDPRVYQ

SEQ ID NO: 14306 - protein, 117 aa, Tuber borchii
SVCQSDTVPISNIIPSGTNSFPNQWKECLFKLLQTNPFPEYTGRVCPAPCEGACVLGINEDPVGIKCIECAIIDRGFEMGWMVPTPPEVRTGKKIAIIGSGPAGFAAADSLNKAGHL

SEQ ID NO: 14307 - protein, 489 aa, Phytophthora infestans
MADLSDIGLFGLAVMGQNFALNMASHGFKVSVCNRSPDKVDATVQRAKDEGNLPLVGFKDMKEFVASLARPRKVVILVVAGKPVDLTIAALSEFMEPGDIIVDGGNEWFPNSVRRASELEPKGIHFVGMGVSGGEEGARNGPSLMPGGPKEAFDALEPIITKCAAQVDDGACTTYLGPIGSGNYVKMVHNGIEYGDMQLIAEAYDILKIAGGLTNDELASVFDEWNKGELESFLIEITAQIFAKKDDLTDDGYVVDKILDKTGMKGTGRWTVQEAAERSIAAPTITASLDARYLSARKDERVFASKILSGPSEIPAVDKQQLIDDVRQALYASKICSYAQGLNLIREAGVQMGWNVDLGECARIWKGGCIIRAKFLDRIKSAYTKDASLISLLVDPDFAAELQARQYSWRRVVSLAVASGIPAPSFSGSLNYYDTFRRERLPANLTQAQRDFFGGHTYERTDREGLYHCAWSAAHHSIGDVSERIRGNL

SEQ ID NO: 14308 - protein, 438 aa, Pseudo-nitzschia pungens
QNFALNMASHGFKVCVGNRSLAKVDSTVARAKEEGGLPLIGATSAEEFIARLRKPRKVVILVQAGKPVDETIKKLSTYMEPGDILVDGGNEWYPNSVRRSGELLHKGIQFIGMGISGGEDGARNGPALMPGGPKQAYDFVAPIFEKCAAQVERTGPCVGYLGPVGSGNYVKMVHNGIEYGDMQLIAEVYDVMKNVLYMPNDEIADVFADWNKTELDSYLIEITEICLRKQDDKTDGYLVDKILDKTGMKGTGLWTAKESAERAVAAPTIVAALDSRVLSSRKEERVAASKIFGPPKIEAVDKDQVIADLRAALYASKICSYAQGLSLIKAASDEFSWNVNLAECARLWMGGCIIRAKLLDSIQMAFSKNPALPNLMIDPGFAEQIIGAQSSWRRTVALCATSGIACPSLCGSLMYFDTYRRERLPACLTQAQRDFFGG

SEQ ID NO: 14309 - protein, 490 aa, Chlamydomonas reinhardtii
MAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 14310 - protein, 346 aa, Porphyra yezoensis
PSLMPGGPRSAYEALEPMLRSIAAQVDDGPCVTYIGTGGAGNYVKMVHNGIEYGDMQLIGEAYDVLKTVGGMSASEIAAVFEEWNESNLQSFLVEITAAILRTSDDLVGDGSALVEKVLDQTGAKGTGMWTVQEAAARLVPIPTIAAALEARYLSALKEDRTAASAVLAGPSTDAAPSVTAEEKAALVAAVRSALYASKICSYAQGMNLIRAAGKEYGWGLDLGSISRIWKGGCIIRAVFLDRIKAAYDVDAELASLLVDPGFASELASAQSAWRSVVTTAINAGVSVPAMSGSLAYYDTYRRTVLPSAQMVQSQRDFFGSHTYKRLDKDGVYHTRWSSDGVTETQ

SEQ ID NO: 14311 - protein, 385 aa, Porphyra yezoensis
HYPDSIRRTKELEKQGILFVGTGVSGGEEGARYGPSLMPGGHPEAWPHIKDIFQAISAKSGDEPCCDWVGENGAGHYVKMVHNGIEYGDMQLICEAYSLLRTVLGLSNDKCADVFDEWNKGSLDSYLIEITANILRYKDTKDGKGDADTPSLVDKIMDRAQQKGTGKWTVGTSLDMGVPVTLISEAVFARMLSSMKEERVRASEKLSGPSSEFKGNAADFIEAVRQALYASKIVSYAQGYMLFREAAKEYNWNLNYGGIALMWRGGCIIRSAFLGDIRDAFTNDPELENLLLSPYFKKEVAGCSEGWREAVAVAARQGVPIPAFMTALAFFDGYRSATLPANLLQAQRDYFGAHTYERVDKKVGEYFHTNWTGTGGDITSNAYAA

SEQ ID NO: 14312 - protein, 473 aa, Nicotiana tabacum
MEFFSLVSIFLFLSFLFLLRKCKNSNSQTKQLPPGPWKIPILGSMLHMLGGEPHHILRDLAKKYGPIMHLQFGEISAVVVTSREMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDVFAKKIREVIGLAEGFDVADIFPSYKFLHVLSGMKRKLLNAHLKVDAIVEDVINEHKKNLATGKTNGALGDMFAAGTETSSTTTVWAMAEMMKNPNVFNKAQAEVRETFKDKVTFDEIDAEELEYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPSGMMPGDLDLTELAGITIARKGDLYLMATPYQPSRE

SEQ ID NO: 14313 - protein, 439 aa, uncultured proteobacterium
MAAPEYPGLDTLALHAGSQPDPATGARATPIYQSASFCFPDSDYAASLFNIERAGHVYSRLSNPTNAVLEERIAALEDGVGAIATASGQAALTLAIMTLMGAGSHIVAAAALYGGSHNLLAYTLPRLGIETTFVDARDPQAFAAAIQDNTRLVFAETVGNPGLDVLNIPEVAAVAHQAGLPLMVDSTFTTPYLIKPFEHGADIIMHSATKFLSGHGIVIGGLLVDGGRFDWDASGKFPTLTEPYAGFHNLVFSEEFGPAAFIQRARKEGLRDFGACMSPTTAFHILQGVETLGIRMHRHVENTRRIVEFLNQHEQVSRVGYPELEGHPDQALASALLPKGCSAVFSFDLVGGREAGIAFVDALNLFSHLANVGDAKSLVIHPASTTHHRMDAAALAAGGIGEGTIRLSIGLEDAKDLIADLKQGLRAAGKVAAKQSVTP

SEQ ID NO: 14314 - protein, 291 aa, Blumeria graminis f. sp. hordei
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLKMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 14315 - protein, 466 aa, Burchardia umbellata
AGFKAGVKDYKLTYYTPDYQTKDTDILAAFRVTPQPGVPPEEAGAAVAAESSTGTWTTVWTDGLTSLNRYKGRCYGIEKVVGEDNQYIAYVAYPLDLFEEGSVTNMFTSIVGNVFGFKALRALRLEDLRIPPAYSKTFEGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLASEGNEIIREACKWSPDLAAACEVWKEIKFEFEAVDKLD

SEQ ID NO: 14316 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 14317 - protein, 466 aa, Isophysis tasmanica
SAGFKAGVKDYRLTYYTPDYETKDTDILAAFRVTPQPGVPAEEAGAAVAAESSTGTWTTVWTDGLTSLDRYKGRCYHIEAVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGELEGEREMTLGFVDLLRDDYIEKDRSRGIFFTQDWVSMPGVLPVASGGIHVWHMPALTEIFGDDSVLQFGGGTLGHPWGNAPGAVANRVALEACVQARNEGRDLAREGNEIIREACNWSPELAAACEVWKEIKFEFEPVDKT

SEQ ID NO: 14318 - protein, 444 aa, Arabidopsis thaliana
MENFLQGSMGYPIIGETFEFMKPHDAIQLPTFVKEKVLRHGPVFRTSLFGGKVIISTDIGLNMEIAKTNHIPGMPKSLARLFGANNLFVNKDTHKHARSLTNQFLGSQALKLRMLQDIDFLVRTHLKEGARKGSLDIKETTSKIIIECLAKKVMGEMEPDAAKELTLCWTFFPREWFGFAWNIPGTGVYRMVKARNRMMKVLKETVLKKRASGEELGDFFKTIFGDTERGVKTISLESATEYIFTLFLLANETTPAVLAATIKLISDHPKVMQELQREHEGIVRDKIEKNEKADLTWEDYKSMTFTQMVINESLRITSTVPTVLRIIDHEFQFGEYTIPAGWIFMGYPYVHFNAEKYDDPLAFNPWRWKGKDLSAIVSRTYIPFGSGSRLCVGAEFVKLKMAIFIHHLSRYRWSMKTETTLLRRFVLILPRGSDVQILEDTKAK

SEQ ID NO: 14319 - protein, 467 aa, Rhodohypoxis milloides
SAGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLASYCRDNGLLLHIHRAMHAVIDRQKNHGMHFRVLAKALRMSGGDHVHSGTVVGKLEGERELTLGFVDLLRDDYIEKDRSRGIFFTQDWVSMPGVLPVASGGIHVWHMPALTEIFGDDSVLQFGGGTLGHPWGNPPGAVANRVALEACVQARNEGRDLAREGNEIIREACKWSPELAAACEVWKAIKFEFEPVDKLD

SEQ ID NO: 14320 - protein, 231 aa, Streptococcus pneumoniae
NSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLVRADFELLDTADKVFAYIRKDGDRRFLVVANLSNEEQDLTVEGKVKSVLIENTLAQEVFEKQILVPWDAFCVELL

SEQ ID NO: 14321 - protein, 467 aa, Tulipa kolpakowskiana
SVGFKAGVKDYKLTYYTPDYETKDTDILAAFRVTPQPGVPPEEAGAAVAAESSTGTWTTVWTDGLTSLDRYKGRCYHIESVVGEENQYIAYVAYPLDLFEEGSVTNMFTSIVGNVFGFKALRALRLEDLRIPPAYSKTFEGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHSGTVVGKLEGEREMTLGFVDLVRDDFIEKDRSRGIFFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFATVDKLD

SEQ ID NO: 14322 - protein, 219 aa, Francisella tularensis
MNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGL

SEQ ID NO: 14323 - protein, 226 aa, Rhizobium etli
MNPMQADAKQLLQEFKQLLQENEITEEKCNIGLAPVTLALTSTQAELANAARSVFTVAQDVSRFGNMGAYTGEVSAELLKDSQIEYVLIGHSERREYFAESAAILNAKAQNALNAGLKVIYCVGESLEQRESGQAEVVVLQQICDLASVVTAEQWPHIVIAYEPIWAIGTGKTASPEDAQTMHAKIREGLTQITSHGANMAILYGGSVKAENAVELAACPDINGAL

SEQ ID NO: 14324 - protein, 165 aa, Rhizobium etli
MNPMQANAQQLIQDLKQRLLQEVVSEQDCHIGIAPISIALLSVKAQLDDASVEIATVARDVSRMAGTGAYTGEVSADLLVDSGIQFVLIGHSERREIFGDNPQILSDKIHYALNANMTIIYCVGESLEQRESGQAEQIVLQQICDVASVVKAEQWHNIIIAYEPI

SEQ ID NO: 14325 - protein, 165 aa, Rhizobium etli
MNPLQTDAQTLLRGVKDLLESTPISAEKCHLGVAPVAIALTQVQAELASAVRPVYTVAQDVSRIAGMGAYTGEVSAELLADSGIGYVLVGHSERREIFGESREILNTKIKNALNAGLTVIYCVGESLEQREAGQAEAVVLQQICDIAAVVEAEQWKNIVIAYEPI

SEQ ID NO: 14326 - protein, 351 aa, Arabidopsis thaliana
MSPEMEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 14327 - protein, 318 aa, Arabidopsis thaliana
MVALDLEFERYPGERSFGSVSLFKYKRQRDGETQYAAVKTSSDENAKSLYKEFQILSQFKGCSRIVQCYGNGVKEIFNDKGYVEYKIAMEYAFGGSLSDFMDRFKDRKLSDSMIREFTRMLLEGLATIHRHGYVHCDLKPENILVFPSSVYKNGAWIRSYELKISDFGMSKRDGDTQWWQPRKPYVGTPIYMSPESISHGEIGKGLDLWSLGCVVLEMYTRKKPWWHTNYELEELMKCYEPLFPRNLPCDAKLFLMTCFASEPDERKDALTLLRQSFLHGDVNKFTNRQMNVKIDSADDFTLQLEKVSQMLSEIRTMC

SEQ ID NO: 14328 - protein, 373 aa, Arabidopsis thaliana
MVPPELEFNKYLGKGSYGSVSLFKYSKPRTTLYTAVMTCNYKNAESLEKEFGILSEFKGCSRIVQCYENRVIENLDVEGNKEYMMLMEYAAGGSLRTFMKRSEDKKLPDPLIREFTRMILEGLATIHGQGYVHCDLKPDNILVFPRCVYKKRAWRSSYELKISDFGLSKRDGDSKWWHPHRPFVGTAIYMSPGSVSHGETGRGLDLWSLGCVVLEMYTGKKPWWHNNYDLKDLKNWYAPMIPSDLPCDAKHFIMACFALNTNERRDALTLLEHSFLRGVVNKITKPHVKNENPKEIALALGRVVRRPSKVLTSIFKRAGELMKIIKKQPRAPRSNLLPVHICHLAQPSQKICFFIYCSLCVVFIILTVVCMFR

SEQ ID NO: 14329 - protein, 187 aa, Medicago sativa subsp. x varia
MTTKFTLVFLLLTLLSIATSTPTNFIKSSCSTTSYPTLCVESLSVYATTIQQDPHQLVQTALSLSLNKTQSTKSFVTKCKSFRGLKPREYAALHDCVEEITDSVDRLRRSLKGLKLCKIQGEDFSWHISNVETWVSSALTDESTCSDGFGGKALDGRMKASIRSRMVNVAQVTSNALSLINQYATKH

SEQ ID NO: 14330 - protein, 310 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVIYPAPILVEKETEEKKTAYPKFVFEDYMKLYAGLKFQAKEPRFDAMKAAAKA

SEQ ID NO: 14331 - protein, 442 aa, Mycobacterium smegmatis
MVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHSSRCPPTRSWSTKFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 14332 - protein, 223 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEA

SEQ ID NO: 14333 - protein, 453 aa, Pseudomonas aeruginosa
MAKAKRMYGCTECGATFPKWAGQCADCGAWNTLVETVVEAAPSGSGRGGWAGQQANLKTLAEVSVEEMPRFTTGSTELDRVLGGGLVDGSVVLIGGDPGIGKSTILLQTLCNLASRVPALYVTGEESQQQVAMRARRLSLPKDKLKVMTETSIETIIATARQEQPRVMVIDSIQTIFTEQLQSAPGGVAQVRESAAMLVRYAKQSGTAIFLVGHVTKEGALAGPRVLEHMVDTVLYFEGDSDAALRMLRAVKNRFGAFNELGVFGMTDKGLKEVSNPSAIFLTRAQEAVPGSVVMATWEGSRPMLVEVQALVDTSHLANPRRVTLGLDQNRLAMLLAVLHRHGGIPTYDQDVFLNVVGGVKVLETASDLALMAAVMSSLRNRPLPHDLLVFGEVGLSGEVRPVPSGQERLKEAGKHGFKRAIVPLGNAPKEAPAGLQVIAVTRLEQALDALFE

SEQ ID NO: 14334 - protein, 171 aa, Psilotum nudum
MPRSQRNDNFIDKTFTIAADILLRVIPTTRREKEAFTYYRDGMSAQSEGEYAEALQNYYKAMRLEIDPYDRSYILYNIGLIHTSNGEHAKALEYYFQALERNPSLPQAFNNMAVICHYRGEQAIQQGDPGTSEIWFDKAAEYWKQAIALAPNNYIEAQNWLRITGRSEDWE

SEQ ID NO: 14335 - protein, 310 aa, Psilotum nudum
MSLINWFEDKRKFGGLIGAFIEKATKGYILSEREKYRDLDVDTTKGSWIRCENCENMLYVKLLKQKKRVCEECGYHLPMNSTERIELLIDHGTWIPIDEDMIAQDILKFHDEESYNNRIVTYQRQTGLTDAIQTGIGRLNGIPVALGVMDFQFMGGSMGSVVGEKITRLIEYATCKSMPLILVCSSGGARMQEGTLSLMQMAKISSVLQIYQVRKKLLYIAVLTYPTTGGVTASFGMLGDINLAEPKAYIAFAGKRVIEQTLRQKIPDGFQVAESLFDHGLLDLIVPRNILKGVLSEIFELYALAPCRKE

SEQ ID NO: 14336 - protein, 466 aa, Tetradoxa omeiensis
SAGFKAGVKDYKLTYYTPDYETKDTDILAAFRVTPQPGVPPEEAGAAVAAESSTGTWTTVWTDGLTNLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 14337 - protein, 466 aa, Sinadoxa corydalifolia
SAGFKAGVKDYKLTYYTPDYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 14338 - protein, 308 aa, Neocallimastix frontalis
MAQKKQQQKLGFYEDFLLAGVSATISKTAAAPLERVKLLVQNQGEMLKSGRLATPYKGIGDCFVRVAKEEGIASFWRGNGANIIRYFPTQALNIAFKERIKNAFAVDKEKEGYAKWLVANIASGGAGGALSQVFVYSLDYARTRLANDAKSANGGERQYKGLIDVYKKTYKADGIAGLYRGFTLSCVGIMVYRGLYFGLYDSMKPLLKNLGMEGSFAASFILGWGVTTVAGIASYPIDTIRRRMMMTSGEAVKYKSSIDCAKQVMQKEGVQAFFKGCGANILRGVAGAGVLSGFDKIKEVYINWRIKN

SEQ ID NO: 14339 - protein, 379 aa, Hordeum vulgare
MATAGKVIKCKAAVAWEAGKPLTMEEVEVAPPQAMEVRVKILFTSLCHTDVYFWEAKGQIPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNAVRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINTAFDLMAKGEGIRCIIRMDN

SEQ ID NO: 14340 - protein, 373 aa, Hordeum vulgare subsp. vulgare
MATAGKVIKCKAAVAWEAGKPLSMEEVEDAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFLNERTLRGTFFGNYKPRTGLPGVVDMYMRKELELDKFITHSLPFSQINTAFDLMLRGEGLRCVIRSEE

SEQ ID NO: 14341 - protein, 199 aa, Lupinus angustifolius
MALCRLVQSPPTNFHFRKYPSKFLKFSSLSLAFRYCHSSMDSPPEGYRRNVGICLMNNDKKIFAASRLDIPDAWQMPQGGIDEGEDPRNAAIRELREETGVTSAEVIAEVPYWLTYDFPPKVREKLNIQWGSDWKGQAQKWFLFKFTGQDQEINLLGDGSEKPEFGEWSWVTPEQLIDLTVEFKKPVYKEVLSVFAPHL

SEQ ID NO: 14342 - protein, 379 aa, Hordeum vulgare subsp. vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGLSTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIATFECVHDGWGVAVLVGVPHKEAVFKTHPMNFLNEKTLKGTFFGNYKPRTDLPEVVEMYMRKELDLEKFITHSVPFSQINTAFDLMLKGEGLRCITRTDQ

SEQ ID NO: 14343 - protein, 354 aa, Pyrococcus furiosus DSM 3638
MDGSGGGFPPSGVPAAARNFIWVVTMHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 14344 - protein, 227 aa, Pyrococcus furiosus DSM 3638
MVEVKKHKFPGVYVVIDDDGSEKIATKNLVPGQRVYGERVIKWEGEEYRIWNPHRSKLGAAIVNGLKNFPIKPGKSVLYLGIASGTTASHVSDIVGWEGKIYGIEFSPRVLRELVPIVEERRNIIPILGDATKPEEYRALVTKVDVIFEDVAQPTQAKILIDNAKAYLKRGGYGMIAVKSRSIDVTKEPEQVFKEVERELSEYFEVIERLNLEPYEKDHALFVVRKP

SEQ ID NO: 14345 - protein, 402 aa, Pyrococcus furiosus DSM 3638
MKAFISENVRGIYAFDENGNLIEKRYFTDKPEKVLDQLLKGEITKDLEELLNSLKEKGYDEFVFEHPELSRRAKELGFSATTEFPNIAGERLRSNPEEFLGENWFEEYYKVGVALTRMRIQEQSGARDKMVIQAIEALDDVDKVINLLVARLREWYSLHFPELDELLPKHPQYVAFVKTVGHRDNINEEVLRELGLSEEKIKKILEAKEKTMGAWMDQTDIEVVRQLAEEIDRLYQLRKKLEDYIDRAMDDVAPNLKALVGAKLAARLISLAGGLRELAMMPSSTIQVLGAEKALFRHLRTGAKPPKHGVIYQYPAINRSPWWQRGKIARALAGKLAIAARVDYFSGEYIAEELKKELEARIREIKEKYPKPPKRKREERKGKKPWKKDKKKKKKKEKPRRR

SEQ ID NO: 14346 - protein, 281 aa, Pyrococcus furiosus DSM 3638
MERAFIEWYPRGYGVAFKIKKKIYEKLSKYQKIEVYETEGFGRLLALDGTVQLVTLGERSYHEPLVHPAMLAHPKPKRVLVIGGGDGGTVREVLQHDVDEVIMVEIDEDVIMVSKDLIKIDNGLLEAMLNGKHEKAKLTIGDGFEFIKNNRGFDVIIADSTDPVGPAKVLFSEEFYRYVYDALNNPGIYVTQAGSVYLFTDELISAYKEMKKVFDRVYYYSFPVIGYASPWAFLVGVKGDIDFTKIDRERAKKLQLEYYDPLMHETLFQMPKYIRETLQRL

SEQ ID NO: 14347 - protein, 480 aa, Pyrococcus furiosus DSM 3638
MKIEDVYIWDINAKWLGITPYQLMENAGAGVAKTIEEKFGKNLRIAVFCGTGNNGGDGFVAARHLSFENDVTVFLIGDESKIRSEEAKLNWNILKNLDFIKIEILKDSSQIKELNLEEFDVIIDALLGAGTRGEPKEPIKSAIEKINEYAGKAKIVSIDLPSGYPSNLRVKADFAVTFQWDKEEYSGFERIVVKIGYPRELYHLAGPAHVKFAFQRRGEHKGQNGKLLIIGGSENYYGAPYLAAKSASYLVDLVYLLTPERVAKKISDPNLIVREVKGENLSLESIDKALELSERVDAVVLGPGLGIKEETKDFVKEFVKRVSKPLVIDADGLKIVSENLDILKGKEFVLTPHAGEFKTLFGVKPEGGLREKAKIVIEKAREIGGVVLLKGKYDIISDGEVWLYNKTGNRGMTTGGTGDVLAGTVGAFLALKNSLLRSAAAGAFLVGFAGDLVAQEKGESFVASDVAEKIPIALKKILEM

SEQ ID NO: 14348 - protein, 430 aa, Pyrococcus furiosus DSM 3638
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 14349 - protein, 485 aa, Pyrococcus furiosus DSM 3638
MGKFVEKLENAIRGYTFDDVLLIPQPTEVEPKDVDVSTQITPNVKLNIPILSAAMDTVTEWEMAVAMAREGGLGVIHRNMSIEEQVEQVKRVKRAERFIVEDVITIAPDETIDYALFLMEKHGIDGLPVVEEDRVVGIITKKDIAAREGRTVKELMTREVITVPESVDVEEALKIMMENRIDRLPVVNEDGKLVGLITMSDLVARKKYKNAVRNEKGELLVAAAVSPFDLRRAIELDRAGVDVIVVDTAHAHNLKAIKAMKEMRQKVSADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLER

SEQ ID NO: 14350 - protein, 266 aa, Pyrococcus furiosus DSM 3638
MKIYYLGPEGSYTEKAALKFAELTNLKITPAESIYSVFREVERGNYGVVPTENSIEGSVTLTLDLLLRFPVKIFGETSLEIKHALLGYDLSKIRVVLSHPQALAQCREFIQRMRWGVRETNSTAEAVKIVAESNDPTLAAIGSREAAEIYGLKVLAEDIQDYPNNKTRFILIGREDMENPLGDKTPQKGAIFLELENVPGALYRALGVFAKRGVNLTRIESRPSLKDLGYYIFYIDYEYTQEEDEILEELKQVSKFLKHLGKYYVV

SEQ ID NO: 14351 - protein, 325 aa, Pyrococcus furiosus DSM 3638
MKTLTEIKQTPKGIIKADESFNQVKDKIRLPRRILYLGCGSSHFLAKLLAMVTNMHGGTGVALPCSEFLYSKEAYPIGKPELVVGISRSGETTEVLLALEKINTPKLGISAYESSLTRACDYSLVVPTIEESVVMTHSFTAFYFAYLQLLRHSYGLPLLEATEVAKATEKALEYENYIKEIVEDFDFQNVIFLGSGLLYPVALEASLKMKEMAIFWSEAYPTFEVRHGFKAIADENTLVVLMAQELFEWHKKLVNEFKGQRARVLLISNSQQEFGQDYSIEVPRLSKDATPIPYLPVVQLLSYYKAVARGLNPDNPRFLDKVVRW

SEQ ID NO: 14352 - protein, 421 aa, Pyrococcus furiosus DSM 3638
MPLKFPEEFLFGTATAAHQIEGDNKWNDWWYYEQIGKLPYKSGKACNHWEFYKEDIQLMASLGYNAYRFSIEWSRLFPEENKFNEEAFNRYQEIIDLLLANNITPLVTLHHFTSPLWFMKKGGFLREENLKFWEKYVEKVAELLEKVKLIATFNEPMVYVMMGYLTAYWPPFIKSPFKAFKVASNLLKAHALAYEILHGKFQVGIVKNVPIMLPATDKERDKKAAERADNLFNWYFLDAIWSGVYRGAFKAYRVPQSDADFIGINYYTASEVRHSWNPLKFFFDAKLADVSERKTQMGWSVYPRGIYIALKKASKYGKPLYITENGIATLDDEWRIEFIIQHLQYVHKAIEDGLDVRGYFYWSFMDNYEWREGFEPRFGLVEVDYETFERRPRKSAYIYGGIAKSKEIKDEILEKYGLSSL

SEQ ID NO: 14353 - protein, 443 aa, Pyrococcus furiosus DSM 3638
MGNIRRRVSIVLLILMAAFLMADQNLLPPNYQQIMKEFGIGETQMGLVSSIFVATSALITIIWGMLADIKQRKKLLVIGVLLGEIPCFLTAYVQTYWQLLAMRFLTGIGIGSIIPIGYSLIADMFEEEKRGRGYSYIETAFGFGTLFGMIIAGMIASWRTPFIIAAVPNFILAPLFYIIAEEPKRGAGEKEIRALIEKGYEYTYRLNLEAIRKSFQTKTNILIFLQGIIGTVPWGILLYWLVSFLQVTRGMDKSTATFVLLIIGIASVFGSLLGGFVGDYFEAKRRGGRATITGIAIFLGMLASIGLILYPLPSKLSTVHWIGLAIYSILFIQFVSYAGPNVRAIVSQVNLPEDRGTVFGLFNILDNVGKAIGPLFGGFLIETLKSMGYMEPLAYQYTLLIGALFWIPCALVWIWIRKSYPEDRDKVKEILKKRAEEILKSKT

SEQ ID NO: 14354 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 14355 - protein, 459 aa, Pyrococcus furiosus DSM 3638
MEYPKIITKLPGPKATEIIERESRILSPGIGVKLFPLVPKRGFGALIEDVDGNIFIDFLAGAAAASTGYSHPKLVKAVQEQVALIQHSMIGYTHNERAIRVAEKLAKISPIKNPRIIFGMSGSDAVDMAIKVSKFSTRRPWILSFIGAYHGQTLGATSIAAFQSSQKRGFSPLMPNVIWLPYPNPYRNIWGIDGYEEPNELINRFLDYLENYVFSHLSPSDEVAALFAEPIQGDAGIVVPPENFFKEVQKVLNDLGILLVMDEVQTGIGRTGKWFASEWFSVEPDLIIFGKGVASGMGLSGVIGRKELMDLTSGAALLTPAANPVVSAAAEATLEIIEEENLLENALKVGNFIKKRLEEMKEVFEVIGDVRGKGLMIGVEIVKDRESKKPDPELTGKICWRAFELGLILPSYGMFQNVIRITPPLVITQEIAEKGLEIMERAIKDALAGKVERKVVTWH

SEQ ID NO: 14356 - protein, 455 aa, Pyrococcus furiosus DSM 3638
MGKLFGTFGVRGTANKDITPEFALKIGMAFGTLLRREGKKKPVVVVGRDTRVSGEMLKSALISGLLSVGCDVIDVGIAPTPAIQWATNHLKADGGAVITASHNPPEYNGIKLLEPNGMGLKKEREAIVEEIFFKEDFDRVEWHEIGEVREVDIIKPYIEAIKSKVDVEAIKKRRPFVVVDTSNGAGSLTLPYLLRELGCKVVSVNAHPDGHFPARNPEPNEENLKGFMEIVKALGADFGVAQDGDADRAVFIDENGRFIQGDKTFALVADAVLRENGGGLLVTTVATSNLLDDIAKKHGAKVMRTKVGDLIVARALYENNGTIGGEENGGVIFPDHVLGRDGAMTVAKVVEIFAKSGKKFSELIDELPKYYQIKTKRHVEGDRYAIVNKVAEMARERGYTVDTTDGAKIIFEDGWVLVRASGTEPIIRIFSEAKSEEKAQEYLDLGIELLEKALS

SEQ ID NO: 14357 - protein, 461 aa, Pyrococcus furiosus DSM 3638
MKTLILAGGKGTRLWPLSRELMPKQFIKVFSNKSLFQKTVERALIFSKPKEIFVVTNKEYRFRVLDDLNEIGVNIPEENILLEPVGKNTLPAIYWGLKVIDESFGDSIVAVLPSDHAIDVNENYIEAFKKAEKLAENYLVTFGIKPTKPHTGYGYIKPGEKISNLGFLVDEFKEKPDLETAKRYVENGYYWNSGMFMFRTTLFMEEARKHAPDVVKAFEEGKTIEEAYELAPEISVDYGIMEKTDKAAVVPLNTYWNDLGSFDAVYEALQKDENGNAVEVRGFKAKYINVDSKNNLILTERLTATVGVEDLIIVDTGDALLVAKKGETQKVKEVYKKLKEENDERAIVHRTAYRPWGSYTVLEEGERYKIKRITVLPGKRLSLQLHYHRSEHWVVVRGTAKVRVGDKEFILRPGESTFIPAGVIHRLENPGKVVLEVIETQIGEYLGEDDIVRIEDDYQRA

SEQ ID NO: 14358 - protein, 506 aa, Pyrococcus furiosus DSM 3638
MSKFIHHKIFDEIYEIGEDGVPEFKTYIAGKWIYGEKFKDIKSPINGEVIARVSILSREQIEEAISTTYEIGREKIRDYPGEKRISSFLKAAEMMKEAFDDFVRILILDAGKPKSNAMGEVKATIERLEKTTFEFGRLIGDYIPGDWSEETLESEAIVKREPYGLILAISPFNYPLFISATKVIPALLSGNAVLLKPASADPLAPILFTRVLELSGLPKESFSLLTVPGGFMDDIVRDKRIRAITFTGSTEVGEHIIRTGGIKAYHLELGGKDPAIVLNDANIEESVEKIVKGIVTYSGQRCDAIRLILVEEDIYEQFRESLVAQLSKIEPKNPLEDENAIMGPLIDEDSANYIEEIYKDAIEKGARPLLEFRRRGNYVWPIVLEVNNEILPTLRAFNEDVFGPLALLIKVKDEDEAIEIANSSRFGLDAAVFTTCEKRARKVARKLEVGSVFINEYPRHGIGYYPFGGMKDSGIGREGIGYSLEMLTTTKTIVHNFRGQGVWEYI

SEQ ID NO: 14359 - protein, 335 aa, Pyrococcus furiosus DSM 3638
MIGSIFYSKKFNLHRPSEYHPENPKRLEIVLSKVRELGLEERIEEPNPVEETFVEKIHDRDYINFVKEAVEKGITRLDPDTYVSPGTWSAALLALGAARSAALSALHYGGLHMALVRPPGHHAGRRGRAMGAPTLGFCIFNNAASAVVTLKEEGVGKVVVIDFDAHHGNGTQEIFWNDPDVIHIDLHERDIYPGSGDVSEVGGSNAYGSKINLPMPHYSGDGDYIYVWDEIVLPIVEEVKPKVIVISAGFDGFKGDGLTTLRLTESFYSYAGATLNKYPLAFILEGGYGVGLDKGFPAFIMGYEEGKAKAREEPRYETLKLAEEVKDILSPWWSL

SEQ ID NO: 14360 - protein, 442 aa, Pyrococcus furiosus DSM 3638
MGWIERYFEFEKYGTDLKTEVLAGITTFMTMAYIIFVNPIILSNAMGPEAFDSLVAATSLAAGLTTILMGIYAKKPFALAPGMGLNAYFAFTVAPKYGWKVALAAVFVEGIIFIILSITKVRSAIIHAIPLSQKYAVGAGIGLFLTFIGLNNVGLLTALTGDNGLLIKTSLNASVLAKPEGLLFLFGLFLTAILLSLRIKGALLISILATSIIGWITGVAPRPEGVFSMPTLSYTFLQLDLKGLLNAGALGAVFAFFMVDFFDTLGTVTGLSAKAGFLTKEGKIPDAEKVLLTDAIGTTFGAILGTSTVTTYIESAAGIEEGGRTGFTAVITGLLFLIIGLFIAPVAKAIPAFATAPALVIVGYYMISAFKEVDFSDPTEAIPAFLVLITIPFTYSIADGIGVGFISYTLLKVFTGRWKEVHPLMYALAVVFIGYFAYLATA

SEQ ID NO: 14361 - protein, 220 aa, Pyrococcus furiosus DSM 3638
MNILIFGPPGSGKSTQARRIVERYGLTYISSGDLIRKEIAEGTPLGREMQAYLARGDLIPDTIVNTLIISKLRRVRKDFIMDGYPRTPEQVIALENYLYDHGIKIDVAIDIYVSLEESIRRVSGRRICPKCGAVYHVEFNPPKIPGRCDVCGAELVQREDDRPEVVEKRYRIYMKNMEPIIKFYQKQRIYVKINGHGNIDEVWERIRPLLDYIRNREAMI

SEQ ID NO: 14362 - protein, 442 aa, Pyrococcus furiosus DSM 3638
MEKKKVVIIGGGAAGMSAASRVKRLRPEWDVKVFEATEWVSHAPCGIPYVVEGIAPKEKLMHYPPEVFIKKRGIDLHLKAEVIEVETGYVRVRENGEEKSYEWDYLVFANGASPQIPEIEGVDLPGVFTADLPPDAVAITEYMEKNKVEDVVIIGTGYIALEMAEAFVTRGKNVTLIGRSERVLRKTFDKEITDIVEEKLRQHLNLRLHEKTLSIEGRERVEKVITDGGEYKADLVIIATGIKPNVELAKQLGVKIGETGAIWTNEKMQTSVENVYAAGDVAETKHVITGKRVWIPLAPAGNKMGYVAGSNIAGKEIEFPGVLGTSITKFMDLEIGKTGLTENEAVKEGYDVRTAFIKANTKPHYYPGGREIWLKGVVDNETNRLLGVQAVGAEILPRIDSAAAMITAGFTTKDVFFTDLAYAPPFAPVWDPLIVLARVLKF

SEQ ID NO: 14363 - protein, 477 aa, Pyrococcus furiosus DSM 3638
MRRVKLPSHKTKIVATIGPATNSRKMIKQLIKAGMNVARINFSHGSFEEHARVIEIIREEAQKLDRRVAILADLPGLKIRVGEIKGGYVELKRGEKVILTTKDVEGDETTIPVDYKGFPNLVSKGDIIYLNDGYIVLKVENVRENEVEAVVLSGGKLFSRKGVNIPKAYLPVEAITPKDFEIMKFAIEHGVDAIGLSFVGSVYDVLKAKSFLEKNNAEDVFVIAKIERPDAVRNFDEILNAADGIMIARGDLGVEMPIEQLPILQKKLIRKANMEGKPVITATQMLVSMTTEKVPTRAEVTDVANAILDGTDAVMLSEETAIGKFPIETVEMMGKIAKVTEEYRESFGLSRIREFMEIKKGTIKEAITRSIIDAICTIDIKFILTPTRTGRTARLISRFKPKQWILAFSTNERVCNNLMFSYGVYPFCLEEGFDENDIVRLIKGLGLVESDDMVLMTEGKPIEKTVGTNSIKIFQIA

SEQ ID NO: 14364 - protein, 359 aa, Pyrococcus furiosus DSM 3638
MKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 14365 - protein, 510 aa, Pyrococcus furiosus DSM 3638
MFPEKFLWGVAQSGFQFEMGDKLRRNIDTNTDWWHWVRDKTNIEKGLVSGDLPEEGINNYELYEKDHEIARKLGLNAYRIGIEWSRIFPWPTTFIDVDYSYNESYNLIEDVKITKDTLEELDEIANKREVAYYRSVINSLRSKGFKVIVNLNHFTLPYWLHDPIEARERALTNKRNGWVNPRTVIEFAKYAAYIAYKFGDIVDMWSTFNEPMVVVELGYLAPYSGFPPGVLNPEAAKLAILHMINAHALAYRQIKKFDTEKADKDSKEPAEVGIIYNNIGVAYPKDPNDSKDVKAAENDNFFHSGLFFEAIHKGKLNIEFDGETFIDAPYLKGNDWIGVNYYTREVVTYQEPMFPSIPLITFKGVQGYGYACRPGTLSKDDRPVSDIGWELYPEGMYDSIVEAHKYGVPVYVTENGIADSKDILRPYYIASHIKMIEKAFEDGYEVKGYFHWALTDNFEWALGFRMRFGLYEVNLITKERIPREKSVSIFREIVANNGVTKKIEEELLRG

SEQ ID NO: 14366 - protein, 443 aa, Pyrococcus furiosus DSM 3638
MEPLEIVRRYEKVIAPANRTTYYPLIPVKAENAKVWDITGKEYIDFLSDAAVQNVGHNNPRVVKAIKDQIEKLVHASYIYLFPIEPLLLAEKLVEIAPIENAKVSFGLSGADANDGAIKFARAYTKRNMILSYMKSFYGSTYGAMSLTGLDFQVRALVGELSGVHYIPYPNCYRCPFGKDRNSCKMECVEYIKEKFEGEVYSEGVAALFAEAIQGDSGMIVPPQDYFKKVKRILDEHGILLVVDEVQSGLGRTGKWFAIEHFDVKPDIITIAKPLGGGLPISATIGRAEIMDSLPPLSHAFTLSGNPTAAKAALAVIEEIEEKDLLKRAEKLGEYTKKKLEELKKKHELVGDVRGLGLMLGVELVKDRETKERAFEETKKVVWRAFELGLIVTFLQGNVLRIQPPLTIEKDVLDEGLEILDQAIEDVEEGKVPDEVIKNVRGW

SEQ ID NO: 14367 - protein, 411 aa, Pyrococcus furiosus DSM 3638
MSVEIGVPEGWDAHSLYMGSRVSMIHLSEEDSKTLEISLDVPRGADLGRYEIPVTLSISGNEYSETKVVTFFVNIYKTYKGENATLNILIIDEEGNPVPKAKVIVGDKEMGTDSSGKAEISIKPGEYEIYVEKEGYEKASKKVEVEDGEVKDVKIILSRKPYYFAVDTESDVYSILLGTPNPPFLITIENLGKNSDEYRLSVRGLPENWNAMFTLSPDSNLEVNKVEVDPGQSKNVYLSVYPSLNALPGDYNLTIIVESISSGTKEEIPITVHLIGTYEMYVNLMNYRLSITAGEEKTTEIEVVNYGNAPVTNVKIEVSAPQGWKVEVDPDSAPMVAPKDRFTSTLKVKVPEGTPAGEYRVTIKVTSDQQEWQDTLRVVVRQRSTSAYIGLALLIVAFLVVIIMIRRVGRR

SEQ ID NO: 14368 - protein, 474 aa, Pyrococcus furiosus DSM 3638
MPRLIKDRVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLIYGIPEFRLPKEIVKKELENLRRLGVKIETNVLVGKTITFEELREEYDAIFIGTGAGTPRIYPWPGVNLNGIYSANEFLTRINLMKAYKFPEYDTPIKVGKRVAVIGGGNTAMDAARSALRLGAEVWILYRRTRKEMTAREEEIKHAEEEGVKFMFLVTPKRFIGDENGNLKAIELEKMKLGEPDESGRRRPIPTGETFIMEFDTAIIAIGQTPNKTFLETVPGLKVDEWGRIVVDENLMTSIPGVFAGGDAIRGEATVILAMGDGRKAAKAIHQYLSKEK

SEQ ID NO: 14369 - protein, 454 aa, Pyrococcus furiosus DSM 3638
MELRPNVKEIPGPKAREIIEKHHKYMATTTNDPNEYFLVIERAEGVYWIDVDGNVILDFSSGIGVLNVGLRNPRVVEAIKKQLDLVLHAAGTDYYNPYQVALAEKLVQITPGDFEKKVFLSNSGTEANEAALKIAKWSTNRKMFIAFIGAFHGRTHGTMSLTASKPVQRSRMFPTMPGVEHVPYPNPYRNPWHIDGYENPDELINRVLEYIEEYLFSHYVPAEEVAGIVFEPIQGEGGYVVPPRNFFKELKKLADKYGILLIDDEVQMGIGRTGKMWAIEHFGIAPDIITTAKALGGGIPIGATIFRKDLDFGVSGVHSNTFGGNAVAAAAALAVMEELENGLLENVQKLEPLFRERLEEMKEKYEIIGDVRGIGLAWGVEFVKDRKTKEYATKERNEVVVEALKRGLALLGCGKSAIRLIPPLIISEEEAKIGLDIFEEAIRVVSERYGYKIH

SEQ ID NO: 14370 - protein, 311 aa, Pyrococcus furiosus DSM 3638
MITAFGEVLIDFIAAEEGDLENVKIFEKHPGGAPANVAVGVSRLGIPSFLVSKVGDDPFGRFLIRRLKEEGVNTEGVLIDNEKHTGVVFVQLKGAKPSFILYDEVAYFNIKLSEVPWEILESSKIVHFGSVLLAREPSRGTMIKVIETLKEKSLVSFDVNIRKDLWRSEEELVETLKRVLSNVDILKLSDEEFNLLKEYGLEPRGKLITAITYGAEGCRIESDEASIFVPAYKVSPVDTTGAGDAFVSALLVGLLALDKQKLEESDMFLLGKFANLVAGLSTQKRGAWSVPRREELEKYEEGRKIFSLITL

SEQ ID NO: 14371 - protein, 331 aa, Pyrococcus furiosus DSM 3638
MVTVELENVTKSFENFRLEVSLKVKDGELLTLLGPSGCGKTTTLRIIAGLESPDSGRVLFDGDDVTSKKPYERNVGFVFQDYALFPHMTVYENIAFGLKVRKIPRGEIERKVKEAIKLVGLEGLENRYPEQLSGGQQQRVALARALVVEPDILLLDEPLSNLDARVRERLRREIRRIQREVGITTVYVTHDQVEAMAISDRIALMNFGKIEQVGEPLDLYLNPKSEFVARFLGDGNLLEARVHDGKAKIGSLEFNISTSSKKVKIFFRPEHVEIGEGDAARVVDYEIIPGRVKVYLEVDNITILAERPLEEIEKIRKGAKVGIKIRRFIVL

SEQ ID NO: 14372 - protein, 438 aa, Pyrococcus furiosus DSM 3638
MRIVVIGSGTAGSNFALFMRKLDRKAEITVIGKEETMQYSPCALPHVISGVIEKPEDVIVFPNEFYEKQRIKLLLNTEAKKIDRERKVVVTDKGEIPYDKLVIATGSKAFVPPIKGVENEGVFTLKSLEDVRKIKEFIKKRNPKNAVVIGAGLIGLEGAEAFAKLGMKVTVVELLEHLLPTMLDKDIAKIVEENMRKYGVDFKFGVGVDEIIGDPVEKVKVGEEEIDADIVLVATGVRANVELAKEAGLEVNRGIVVNEYLQTSDPDIYAIGDCAEVIDAVTGKRTLSQLGTSAVRMAKVAAENIAGRNVKFRPVFNTAITEIFDLEIGAFGITEERAKKEEIEVVVGKFRGSTKPEYYPGGKPIVVKLIFRKEDRRLIGAQIVGGERVWGRIMTLSALAQKGATVEDVVYLETAYAPPISPTIDPITIAAEMAMRKL

SEQ ID NO: 14373 - protein, 221 aa, Pyrococcus furiosus DSM 3638
MEFQLDLIRGEHMEIEKLLEQVNWEKNNGIVPVIVQDEKGEVLTLAYMNKEALRKTLETGIAHYYSRSKGRIRMKGEVSGNIQTVKEIKIDCDNDALLLIVSPKGPACHTGNYSCFYRKLGEPERVLPIDYSLSILKELEEIIKRRKETPVEGSYTSKLFKEGREKIYKKFGEEAIEVLVAEKRERIIYEVADLLYHLLVLLTYNDISLGEVMNELRRRRK

SEQ ID NO: 14374 - protein, 366 aa, Pyrococcus furiosus DSM 3638
MSLYRKRLRLVKGEGIYVWDSQGKKYIDLIAGIGVNVLGHNHPEWVSELQEQLEKLVVAGPMFDHEEKYEMLEELEKFVTYEYVYIGNSGTEAVEAALKFARLYTGRKEIIAMTNAFHGRTMGALSATWKPKYREDFKPLVPGFKHIPFNDVEAAKEAITTETAAVIFEPIQGEGGVVPANEEFVKTLRDLTEDKGALLIADEVQSGLRTGKFLAIEHYKVEPDIVTMGKGIGNGVPVSLTLTNFDVERGKHGSTFGGNPLACKAVAVTLRILRREKLIEKAAEKFIEIKGENVVLTRGKGLMIGIVMKKPVAKVVEELQNRGYLVHTAGQRVIRLLPPLIISKDEINQAKSAIEGVINDIYGRKN

SEQ ID NO: 14375 - protein, 248 aa, Pyrococcus furiosus DSM 3638
MFKDGSLIPYLTAGDPDKQSTLNFLLALDEYAGAIELGIPFSDPIADGKTIQESHYRALKNGFKLREAFWIVKEFRRHSSTPIVLMTYYNPIYRAGVRNFLAEAKASGVDGILVVDLPVFHAKEFTEIAREEGIKTVFLAAPNTPDERLKVIDDMTTGFVYLVSLYGTTGAREEIPKTAYDLLRRAKRICRNKVAVGFGVSKREHVVSLLKEGANGVVVGSALVKIIGEKGREATEFLKKKVEELLGI

SEQ ID NO: 14376 - protein, 312 aa, Pyrococcus furiosus DSM 3638
MIYAIGEILIDFIAKEEGKLKDVREFEKHPGGAPANVVVGLRRLGAKSALISKVGDDPFGEFLIEELKKERVETKYIIKDTNKHTGIVFVQLIGAKPEFILYDGVAYFNLRKEEIQWDFMRDAELLHFGSVLFAREPSRSTVFEVLRAVKGKVPISYDVNIRLDLWRGREKEMLKDIEEALKLADIVKIGDGELEYLNKNGIALEDFNFALVAITRGAEGSTIIHKDIRVDVPSFKVEPVDTTGAGDAFMAALLASLFYMGKLDILEFSKEELKELGSFANLVAALSTTKRGAWSVPSLEEVLKHRKFSFLP

SEQ ID NO: 14377 - protein, 337 aa, Pyrococcus furiosus DSM 3638
MVRLRLEDIEFKQADFRLDIPFLEAKPGEFLTLLGPSGCGKTTTLRIIAGFEKPDKGKIYFDDTVMNDVPPYERNIGIVFQDYALFPHMTVYDNISFGLKLRKLSKEEIKRRVSWALELVGLKGFEDRYPEQLSGGQQQRVALARALVIEPQLLLLDEPLSNLDAKIRERLRGEIKRIQKELGITTIYVTHDQEEAMAISDRIAVMSVGKIEQVGNPLDLYYNPKNEFVARFLGLSNILEVNAEEGKAYVGNLCFEVKTEGRVKIFFRPESVYIEEGDMGEIVDYELLPGRIRLKIDVEGKVIIAERFLDEIPFSIEKIPKKVGIKVKSFSILSSSP

SEQ ID NO: 14378 - protein, 357 aa, Pyrococcus furiosus DSM 3638
MEKRVSEMKFCFCGEKKDSRVKPLRVAIIGAGPAGLSAACSLACDGFDVHVYDKMPEPGGMVAFGIPEWRIPISKVRQAVKEIEELGVVFHMRTKVVYDSPKELGDEFAERFVSLEKLMKEYDAILIATGAWRPRILDIPGKELKGVENALQLLLRINLARIGYLPQTKMPSFEGKRVVVIGAGYTAVDVAKEAKLLGAKSVTIAYRRSLQDSYAKNEFKKLIKEGVKFLEYVTPVRIFGDENVREVEFAKTKVVRGSVITTEEKRTIPADVIIFAIGQIPTNPIKEVLCSNEDILKNAGIFFAGDVISPRNIGTAIREGRKVAEEIKAWLTEHAFLNIRLSYPVSLRDISKSATQC

SEQ ID NO: 14379 - protein, 284 aa, Pyrococcus furiosus DSM 3638
MFFAKLEFFNPFSRSIKDRPVYNMIMKAIESGEIDGTDTLYEATSGNVGIALAALSAVLGLKFRAYVPKPTPKITEILIKMFGAEVIRTKFETIDPEFINFVKEEAKKDKAVNLNQFENDANFEAHYYGTAKELDEQLKSIKKKPEVIIAGVGTSGHIAALSKYFKEKYGTKIIGVVPAEGEKIPGIKRIETKPKWFFQVKVDKVVEITTREAVEGALRVARTDGLIIGLSSGAVVKAYEKINPKGTTVLIFPDDGFKYVEIFQAFLQEAQDTTSSQTARHQSP

SEQ ID NO: 14380 - protein, 389 aa, Pyrococcus furiosus DSM 3638
MKRFYIANEDEIKAGKTTDVYFLRTKKILEVKNIRKKVLADVTTTSLPNNWRWGVLVGVEEVAKLLEGIPVNVYAMPEGTIFHPYEPVLQIEGDYADFGIYETALLGMLSQASGIATAALRIKIAAKFKPVYSFGIRHMHPAIAPMIDRAAFIGGCDGVSGVLGAEMMGEKAVGTMPHALIITVGDQVKAWKYFDEVIEEEVPRIALVDTFYDEKVEAVMAAEALGKKLFAVRLDTPSSRRGNFRKIIEEVRWELKVRGYDWVKIFVSGGLDEEKIKEIVDVVDAFGVGGAIASAKPVDFALDIVEVEGKPIAKRGKLSGRKQVYRCENGHYHVVPANKKLERCPVCNAKVEPLLKPIIENGEIVVEFPKAREIREYVLEQAKKFNLEI

SEQ ID NO: 14381 - protein, 476 aa, Pyrococcus furiosus DSM 3638
MPRLIKERVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLTYGIPEFRLPKEILRKELKKLSLLGVEIKTDHIVGKTITIQELLQEYDAVFIGTGAGTPKLPNIPGINLNGIYSANEFLTRINLMKAYKFPEYDTPIVVGKKVVVIGAGNTAMDAARSALRLGAEVTIAYRRGREDMTARIEEVKHAEEEGVKFMFFVNPVEFIGDENGNVKAVKFEKMKPLEERDSRGKRKIVGTGEYITVEADTVIIAIGQTPNKVLWRATPELKVDEWGRIVVDENLMTSIPGVFAGGDAIRGEATVILAMGDGRKAAKAIHQYLSKKGN

SEQ ID NO: 14382 - protein, 321 aa, Pyrococcus furiosus DSM 3638
MKIQRKLLRQKVSFDFSFLLIKFLNSSLARLFGDDMLLHTYKSFDMELPLVNIKDADYVILGLPYDGTTSYKPGARFGPVLIRQATLNFESYILDYDVDLAEAKIADAGDVALPVSIEEALKVAEETVRELREINPKALPIFLGGEHSMTLAPVRVLKPKSYVVFDAHLDLRDSYGGSKFNHACVARRINELRVEVAIFGVRSGTKEEVDFARKNGIEWIHARDYSFEAFVDIVSTLPEPIYLSIDIDTFDASLVPETGTPEPGGLRFWDVVEALEWLSESREVIGIDIMEVGGEKLGNVTALTGAKLLFYLLGMFEGIKK

SEQ ID NO: 14383 - protein, 278 aa, Pyrococcus furiosus DSM 3638
MKRVNAFNDLKRIGDDKVTAIGMGTWGIGGRETPDYSRDKESIEAIRYGLELGMNLIDTAEFYGAGHAEEIVGEAIKEFEREDIFIVSKVWPTHFGYEEAKKAARASAKRLGTYIDLYLLHWPVDDFKKIEETLHALEDLVDEGVIRYIGVSNFNLELLQRSQEVMRKYEIVANQVKYSVKDRWPETTGLLDYMKREGIALMAYTPLEKGTLARNECLAKIGEKYGKTAAQVALNYLIWEENVVAIPKASNKEHLKENFGAMGWRLSEEDREMARRCV

SEQ ID NO: 14384 - protein, 386 aa, Lycopersicon esculentum
MADMNQHPTVFQKAANQLDLRSSLSQDVHARYGGVQPAIYQRHFAYGNYSNAGLHRGQATQDLSLITSNASPVFVQAPQEKGFAAFATDFLMGGVSAAVSKTAAAPIERVKLLIQNQDEMLKAGRLSEPYKGIGDCFGRTIKEEGFGSLWRGNTANVIRYFPTQALNFAFKDYFKRLFNFKKDRDGYWKWFAGNPASGGAAGASSLFFVYSLDYARTRLANDAKASKKGGERQFNGLVDVYRKTLKSDGIAGLYRGFNISCVGIIVYRGFYFGMYDSLKPVLLTGNLQDSFFASFALGWLITNGAGLASYPIDTLRRRMMMTSGEAVKYKSSLDAFSQIVKNEGPKSLFKGAGANILRAVAGAGVLAGYDKLQVLVLGKKYGSGGA

SEQ ID NO: 14385 - protein, 333 aa, Ipomoea purpurea
MLELPKADTNLTVWKGVMEEEGSFDEAIAGCEGVFHVATPMDFDSKDPENEVIKPTINGVLNIINSCVKAKTVKRLVFTSSAGTLNVQPQQKPVYDETCWSDLDFIYAKKMTGWMYFASKILAEKEAWKATKEKKIDFISIIPPLVVGPFITPTFPPSLITALSLITGNEAHYSIIKQGQYVHLDDLCEAHIFLYEHPKAEGRFICSSHHTTIHGLADMITHNWPEYYIPSQFKGIEKELAVVYFSSKKLQDMGFQFKYSLEDMYRGAIETLRKKGLLPYSTKEAAAIEEEQETVPLKVEEPTAIEQKQETVPLKFEEPTAIEQKQEVVPLKA

SEQ ID NO: 14386 - protein, 300 aa, Persea americana
MVPSSPILFSSKPPCPFLPIPSKPIKLIHLSTSSSSWVSFKKSPSPSSRSLTTLVAQTSDWAQQEEDSNVAEATLSDWEGEGEGEGEEQTESGAEDGEESGGDGFVEGGEEDSYPLPPEEAKLFVGNLPYDVDHQALAELFDQAGTVEVAEVIYNRETDQSRGFGFVTMSTVEEAEKAVEMFNRYDINGRLLTVNKAAPRGARVDRPPRAFEPAFRMYVGNLPWQVDDARLEQVFSEHGKVVEARVVYDRETGRSRGFGFVTMSTQTELDDAIAALDGQSLDGRAIRVNVAEDRPRRASF

SEQ ID NO: 14387 - protein, 315 aa, Persea americana
MANTSISPLSTLFCPKTLIPFLSIPSKAKLLHLSHSTSSVPSWVSLKSKLSSSGGSFIALVARTSDWARQDGDNEIGEAGFDWEGEGTEAQVSDWEGEVEEDGEVLGESGAEDEEESGEVGFADEEDSYSAPPEEVKIFVGNLPFDLESADLADLFNKAGVVESAEVIYNRETDQSRGFGFVSMSTVEEVVKAIEMFDRYDINGRTLTVNKAAPRGSRAERPPRDFEPAFRVYVGNIPWQVDNLRLEQLFSEYGKVEEARIVFDRETGRSRGFGFVTMSSQIEMEDAIAALDGSDLDGRAIKVSMAQERPRRGHF

SEQ ID NO: 14388 - protein, 154 aa, Saccharomyces cerevisiae
GAASGTSVSHVSDVVGPEGVVYAVEFSHRPGRELISMAKKRPNIIPIIEDARHPQKYRMLIGMVDCVFADVAQPDQARIIALNSHMFLKDQGGVVISIKANCIDSTVDAETVFAREVQKLREERIKPLEQLTLEPYERDHCIVVGRYMRSGLKK

SEQ ID NO: 14389 - protein, 417 aa, Pseudomonas stutzeri
MDSTALIPVQYGLDTFYFVICGALVMWMAAGFAMLEAGLVRAKNTAEILTKNIVLYALASIMYLLVGYYIMYSSPEGGIFPSLGFLIGDEHAVDLVAAGGEDAPYYSARADFFFQIVFAATCMSVVSGAVAERMKLWAFIAFAVVMTGFIYPIQGFWKWGGGFLDAAGFLDFAGSGVVHMAGAAAALAGVLLLGARKGKYGPNGQINAIPGANMPLATLGAFILWMGWFGFNGGSQLKMSTIEDANAVAQVFVNTNMGAAGGLIAALITARLLFGKSDLTMVLNGALAGLVAITAEPLTPSALQATLIGGVGGVLVVFSILGLDKLKLDDPVGAISVHGVAGMWGLLAVTADQCRRFFRQSSCLGLVSIFLWVFFASLIVWGIIKAVMGLRVSEEEEYEGVDVVECGLEAYPEFTRQ

SEQ ID NO: 14390 - protein, 379 aa, Thermoanaerobacterium thermosaccharolyticum
MDFSLTKEQEMVRRVVREFAEKEVAPKAKEIDITEEFPWDTVRKMAQNDMMGIPYPEEYGGAGGDYLSYIIAVEEISRACATTGVILSAHTSLGSFPIYQWGTEEQKRKYLVPLAKGEKLGAFGLTEPNAGTDAAGQQTTAVLDGDHYVLNGSIFITNGGKADIYIIFAMTDKSKGTRGISAFIVEKDFPGFSIGKIEEKMGIRASSTAELVFEDCIVPKENLLGKEGEGFKIAMATLDGGRIGIAAQRLGIAQAALDEEIKYAKERQQFGRPIGKFQGIQWYIADMATRINASRWLVYNAAWRKQVGLPYTMEAAMAKLYASETAMFVTTKTVQIFGGYGFTKDYPVERFMRDAKITEIYEGTSEVQKMVISGNLLKM

SEQ ID NO: 14391 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGLRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 14392 - protein, 453 aa, Rhodococcus globerulus
MDVREAIRTQPMRRYQISTIAICLILSMIDGFEILVMAFVAPHLGKSWDISSVEIGYLLSAGIIGTALGAIFISPLADKIGRRRLAIWCLVGITVGMALSACAVNVPQLIAFRAFAGLGIGGLVANLNVLVSEFSSDKRRGTALGIYGVGYPLGGAVGGAISGVLISVFDWRSAFIFGTIITAIMLVVVIKTLPESIEFLIEKRPVGALERYNEIADRLGYEQSSELPVPIRKTERVVRDGLFKGIMLRRTVFLWLGYSCLIASFYFANTWTPKLLSDATGDSNMGVTAGVLVNVGGVIGSIIFAGLSIVLRPRVVTVLLMFGGVFAFIGYASGFHIVALALTLAVLVGIFANGGITGFYAISPPIYPAAARGTGVGWMIGCGRTVSIIAPILTGYLLDGGWTPKSVYMMFGGVLVIAGIATLLLDATYRGRSENPETPEARREEDLAAAATA

SEQ ID NO: 14393 - protein, 388 aa, Hordeum vulgare subsp. vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 14394 - protein, 462 aa, Nicotiana sylvestris
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 14395 - protein, 1476 aa, Neurospora crassa
MASTTQIKTPQEAVARIAYLASDVVVSVQPSLAAESDFSATLKSLASSRTQSLVAKAADAVTEIIPVRHNNDPLLSVFTPIRSGRLVSVTTTSEVLLPSIAHLYKLAQLPVVLHVALGPKSLPDYTAITSIRNSGWTFLQSNSLQEAQDLALTAHALAVQSGKGVIHFFDPSSSASEQPIAAEDLSLVQEILNLDNVRRFQSASISGSSIYANDGRVAVVSEQSEPVASQTVLDARQVEAATATATDSLAPAQDGSDDAFEYSGPSNAENALFVFGSGSPLFAQAIAQAQSDDSFAKAGVLTARLYRPWLGAKLLEAIPKSVKRVAVLEQVSRKTTKWGPLLIDVLTSVKSGPGGVQTIVGHQLGYISQETVVQALRGIFQNLTSEKPVQNLEVGEREAPKEASEYGLEKPKLETAYTKILDQLFGERAYIANSIEKDNAGISNTISATPEYGFGALLARKERKQKFVSEVKEAASNGQFSSDAPKQALAKWVANAEDSKKVEEVASEAVSKLSEDGSDLSKSLLEYKQFFRKQSLWLVGSDAWSYDLGNSGVHHVLASGENVNLLIIDSTPYSERAAADANRRKKDIGLYAMNFGNAYVASTAVYSSYTQVLQAMDEADKFNGPSVVLAYLPYFGEHDSALTVLQETKKAVDIGYWPLYRWNPENEKKGEPSFSLDSERIKKELKEFLDRDNHLTQLMKKEPSFGAVLSEDFGTEIRAQQKRKAKDAYNQLLEGLFGAPLTILYASDNGNAISLSKRLGNRGRARGLKTTVMSMEDYPVEDLATEENIVFITSTAGQGEFPQNGLSFWHAVKDNTSLDLANVRYSVFGLGDSHYWPRKEDKIYYNKPAKDLDRVLANFGAKPLAPIGLGDDQDPDGFQTGYSEWEPKLWEALGVANVDGLPEEPAPRTNEDIKIESNYLRGTIVQGLNDTSTLAISPDDCQLTKFHGTYMQDDRDIRDERKAQGLEPAYSFMIRCRLPGGVSTAKQWVQMDDIANELGNETMKLTTRQTFQFHGVVKSKLKPAMQAINRALMTTIAACGDVNRNVMCSPLPAHSKYHRAVHACAKRISDHLLPNTTAYHEIWLTDDDGAKTQVGGNAVQDFEPLYGPTYLPRKFKVSIAIPPHNDVDVYAHDIGLIAIKNEDGSLAGFNLLAGGGMGATHNNKKTYPQTGRMLGFVTAADVHLACEKVMLVQRDNGDRKNRKHARLKYTIDDMGVDVFKAKVEEYWGQKFEEPRAFHFDSNVDTFGWTKDETGLNHFTMFIENGRIEDTAEFQMKTGLREIAKVHKGEFRLTPNQHLILSNVADEDKPELEKLLAQYKLDNLHHSGLRLSSSACVAFPTCGLAMAESERYLPVLITKLEGVLEEVGLKQDSIVMRMTGCPNGCARPWLAEVAFVGKAYGAYNMYLGGGYHGQRLNKLYRSSIKEEEILTIMKGLLRRYAKEREEGERFGDWTIRAGIIKATTDGRNFHEGVSEIF

SEQ ID NO: 14396 - protein, 281 aa, Cucumis melo
TLEDGMKVAVKRGNPRSEQGLAEFRTEIEMLSKLRHRHLVSLIGYCDERSEMILVYEYMANGPLRSHLYGTDLPPLSWKQRLDICIGAARGLHYLHTGAAQSIIHRDVKTTNILLDENFVAKVADFGLSKTGPSLDQTHVSTAVKGSFGYLDPEYFRRQQLTEKSDVYSFGVVLMEVLCTRPALNPVLPREQVNIAEWAMTWQKKGMLDHIMDPNLVGKVNPASLKKFGETAEKCLAEYGVDRPSMGDVLWNLEYALQLEETSSALMEPEDNSTNQSLPSN

SEQ ID NO: 14397 - protein, 357 aa, Blumeria graminis
MAEFVRAQIFGTTFEITSRYSDLQPVGMGAFGLVCSAKDNLTGQNVAVKKIMKPFSTPVLSKRTYRELKLLKHLRHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIHTIASENTLRFVQSLPKRVRQPLKDKFTNADPLAIGLLEEMLVFDPRRRIKATDALAHEYLAPYHDPTDEPIALEKFDWSFNDADLPVDTWKIMMYSEILDYHNVDSENQAMEDPLECP

SEQ ID NO: 14398 - protein, 145 aa, Enterococcus faecium
AEKIIDAYGIPHISTGDMFRAAMQNETALGLEAKSYMDKGALVPDEVTNGIVKERLAEPDTERGFLLDGFPRTLDQAKALDAMLKDLNKKIDAVIDIHVGEEILVERLAGRFICSNCGATYHKIFNPTKVEDTCDRCGGHEFYQR

SEQ ID NO: 14399 - protein, 145 aa, Enterococcus faecium
AEKIIDAYGIPHISTGDMFRAAMQNETALGLEAKSYMDKGALVPDEVTNGIVKERLAEPDTEKGFLLDGFPRTLDQAKALDAMLKDLNKKIDAVIDIHVGEEILVERLAGRFICSNCGATYHKIFNPTKVEDTCDRCGGHEFYQR

SEQ ID NO: 14400 - protein, 1459 aa, Monilinia fructicola
MAANEAEGFTSIVRRERPVSAISRPVSGLSRVLSTSSAFSERRASRLYDDFDEDNKDEPISMAEDWGLMPEIQAMREQGEKDQVKRRDLGVTWRNLTVKGIGADAAINENVGSQFNIPKIIKEGRASPPLRTLVDSSHGCVKPGEMLLVLGRPGAGCTTLLKMLANNRAGYAEVTGDVHFGSLNHTEAHQYRGQIVMNTEDELFFPTLTVGQTIDFATRMKGPHNLPSNQSTPLEYQQRSRDFLLKSMGISHTHETKVGNEYVRGVSGGERKRVSIIETLATRGSVMCWDNSTRGLDASTALEYTKAVRALTDIFGLASIVTLYQAGNGIYNLFDKVLVLDEGKQIYYGPMKQARPFMEDLGFICDDSANVADFLTGVTVPTERKIRDGFHDRFPRTADEILAAYNNHPIKSEMEKDYDYPNTAVAKQRTSDFRESVQHEKYPRLSKKSPLTTSFTTQVKACIIRQYQIIWGDKATFIIKQLSTLAQALIAGSLFYNAPNNSAGLFVKSGALFLSLLFNALLAMSEVTDSFSGRPVLAKHKAFALYHPAAFCIAQIAADIPVLFVQISHFSLVMYFMVGLRQDAGAFFTYWVIIFATTMCMTALFRAVGAGFSTFDAASKVSGFLISALIMYTGYMIQKPDMHPWFVWIYWIDPLAYGFSAVLANEFKGQIIPCVGTNLVPNGPGYADLTYQACAGVGGALPGAVSVTGEQYLNSLSYSTDNIWRNFGILWAWWVLFVGLTIYCTSNWSSSAGKSGFLLIPREKAHHNASVLKAANAGDEESGAAQEKRQQDVHSASEDTKVGDENDDQLMRNTSVFTWKNLTYTVKTPSGDRVLLDNVQGWVKPGMLGALMGSSGAGKTTLLDVLAQRKTDGTIKGSILVDGRPLSVSFQRSAGYCEQLDVHEPFATVREALEFSALLRQSRTIPEAEKLKYVDTIIDLLEMHDIENTLIGTTGAGLSIEQRKRLTIGVELVSKPSILIFLDEPTSGLDGQAAFNTVRFLRKLADVGQAILVTIHQPSAQLFAQFDSLLLLAKGGKTVYFGDIGENSQTIKEYFARYDAPCPESSNPAEHMIDVVSGSLSKGKDWNEVWLNSPEYQYTVTELDRIINTAAAAPPGTSDDGFEFAMPMWQQIKLVTNRMNVSIYRNTEYINNKFALHIGSALFNGFSFWMIKDSVGGLQLRLFTIFNFIFVAPGVMAQLQPLFLERRDIYEVREKKSKMYSWWAFATGNVVSELPYLCICAVLYFVCWYYTGGFPSDSNKAGAVLFVMICYEFIYTGIGQFVAAYAPNVVFASLVNPLVIGTLVSFCGVLVPYAQITAFWRYWMYYLNPFNYLMGSLLVFTTWDTPVRCRESEFAIFNPASGTCGEYLSSYLQGMGAAANLTNPDATSGCRVCEYRSGKDYLQSLNLQTYSYGWRDAGICALFVFSGYALVFLLMKLRTKKNKGAEVGWPRGGVSTIVY

SEQ ID NO: 14401 - protein, 361 aa, Saccharomyces cerevisiae
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 14402 - protein, 483 aa, Methylobacterium extorquens
MMEAPLKRSRRTKIVATLGPASDTPEMIEKLFHAGADVFRINMSHLAREKLPERIEVIRTIEREGKRPIGILVDLQGPKLRLGTFVGDAAVLENGQTFVLDSDPTPGDTDRVFLPHPEILSALEPSHGILIDDGKLRLIVTEVSEGRAVTRVEVGGRISNRKGVSLPHTALPVPAMTEKDRGDLEAGLAAGADWIAVSFVQRPEDVAEVKKVAAGRALVMAKIEKPQALTRLDEIIEISDGIMVARGDLGVEMPLEQVPGVQKRITRVARRLGKPVVVATQMLESMITSPVPTRAEVSDVATAVYEGADAVMLSAESAAGDFPVEAIGTMNRIAEQVERDALYWSILMAQRSEPEPTASDAIAAAAHQIVEALSLRSIMAWTHSGSTVLRLARARPNASVIALTPKRETARRLTMAWGVHPIVTKDASDVDDMAFRAAKFAVRERFAEIGDRVIIVAGVPFGIPGATNMVRIAFVTREHAERA

SEQ ID NO: 14403 - protein, 464 aa, Pseudomonas fluorescens
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDLFFGTGSFADEQTVEVVCANGVVEKLVAKHIIIATGSRPYRPADIDFHHPRIYDSDTILSLGHTPRKLIIYGAGVIGCEYASIFSGLGVLVELVDNRDQLLSFLDSEISQALSYHFSNNNITVRHNEEYDRVEGLDNGVILHLKSGKKIKADALLWCNGRTGNTDKLGMENIGVKVNSRGQIEVDENYRTCVTNIYGAGDVIGWPSLASAAHDQGRSAAGSIVDNGSWRYVNDVPTGIYTIPEISSIGKNEHELTKAKVPYEVGKAFFKSMARAQIAGEPQGMLKILFHRETLEVLGVHCFGYQASEIVHIGQAIMNQPGEQNTLKYFVNTTFNYPTMAEAYRVAAYDGLNRLF

SEQ ID NO: 14404 - protein, 327 aa, Citrus hystrix
MSNTSLLSLIFILSLFIPPSLSDLCNPNDKKVLLKFKKALNNPYVLASWNPKTDCCDWYCVTCDLSTNRINSLTIFAGDLPGQIPSEVGDLPYLETLMFHKLPSLTGPIQPAIAKLKNLKTLRISWTNISGPVPDFISQLTNLTFLELSFNNLSGTIPSSLSKLQKLGALHLDRNKLTGSIPESFGTFTGSTPDLYLSHNQLSGKIPASLGSMDFNTIDLSRNKLEGDASFLIGLNKTTQRIDVSRNLLEFNLSKVEFPESLTNLDLNHNKIFGSIPAQITSLENLGFLNVSYNRLCGPIPVGGKLQSFGYTEYFHNRCLCGAPLER

SEQ ID NO: 14405 - protein, 177 aa, Hordeum vulgare
LAGDSPGNVPGSWKEPGIGWMTGFLLACSFGGLLTLIPLRQVLAVDYKLVYPSGTATAILINGFHTDQGDKNSRKQIRGFLKYFGGSFMWSFFQWFYTGGDACGFVQFPTFGLKAWKQTFYFDFSMTYVGAGMICPHIVNISTLLGAIISWGIMRPLISKNKGDRYPAKVPESSMKS

SEQ ID NO: 14406 - protein, 512 aa, Schizosaccharomyces pombe
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGGPYLYQRYPKKMTVLGGGIIGLEMGSVWSRLGAEVTVVEFLPAVGGPMDADISKALSRIISKQGIKFKRSTKLVSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFGFSANSRAKTNMDADGLVKVIVDAETDRLLGVHMIGPMAGELIGEATLALEYGASAEDVARVCHAHPTLSEATKEAMMAAWCGKSIHF

SEQ ID NO: 14407 - protein, 418 aa, Thermococcus sp.
MFRFPDGFLLGTATSSYQIEGDNVWSDWWYWAEKGKLPPAGKACNSWELYEKDLELMAGLGYAAYRFSIEWGRVFPEEGRPNEEALMRYQGIIDLLRENGITPMLTLHHFTLPAWFALRGGFEREENLEHWRGYVELIADNIEGVELVATFNEPMVYVVASYVEGTWPPFRKNPLKAEKVAANLIRAHAIAYEILHGKFRVGIVKNRPHFIPASDSERDRKATDEIDYTFNRSLLDGILTGRFKGFMRTFDVPASGLDWLGMNYYNIMKVRAVRNPLRRFAVEDAGVSRKTDMGWSVYPKGIYDGLRAFAEYGLPLYVTENGIATLDDEWRVEFIVQHLQYVHKALKEGIDVRGYFYWSLVDNYEWAEGFRPRFGLVEVDYETFERKPRKSAHIYGEIAKKGEIRGELLEGYGLGEKL

SEQ ID NO: 14408 - protein, 328 aa, Lycopersicon esculentum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 14409 - protein, 406 aa, Escherichia coli
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPADIRHAAYNDINSASALIDDSTCAVIVEPIQGEGGVVPASNAFLQGLRELCNRHNALLIFDEVQTGVGRTGELYAYMHYGVTPDLLTTAKALGGGFPVGALLATEECARVMTVGTHGTTYGGNPLASAVAGKVLELINTPEMLNGVKQRHDWFVERLNTINHRYGLFSEVRGLGLLIGCVLNADYAGQAKQISQEAAKRGVMVLIAGGNVVRFAPALNVSEEEVTTGLDRFAAACEHFVSRGSS

SEQ ID NO: 14410 - protein, 386 aa, Catharanthus roseus
FLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 14411 - protein, 382 aa, Catharanthus roseus
SEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 14412 - protein, 476 aa, Lycopersicon esculentum
FYNFSKKLQGMAKTNGFMGHDMLAPFTAAWMIDMGPLVIDKAEGSYVYDVNGKKYLDSLSGLWCSVLGGSEPRLIEAANKQLNKLAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKFQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKKKKKKKKKKKKKKKKKKK

SEQ ID NO: 14413 - protein, 313 aa, Lycopersicon esculentum
FRPLQDKMNKLEGGRRDYHPVDELQGSSWNHIPTPERVKKPKPTPVPNISKKQERMQNHSSASTPSLPVPPPNPPARQQSPLSTPSPVRAPAAKPQSAAKVPTMGKQPKPRAKDPNKREMNMEEKHKLGVGLQSLPQEKMPQLVQIIRKRNEHLAQDGDEIELDIEALDTETLWELDRFVTNWKKMVSKTKRQALMNNLGPPSASAAASAATTSVAEADGPTTSEKNDSFKKAKKGDVGEEDVEIEDDEPATHFPPVEIEKDEGGGRDQENGGGGGSSSSSSSSSSSSGSSSSSDSDSGSSSGSDSDADDAHS

SEQ ID NO: 14414 - protein, 475 aa, Streptococcus agalactiae
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVLDMK

SEQ ID NO: 14415 - protein, 398 aa, Streptococcus agalactiae
MAKLTVKDVDLKVKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 14416 - protein, 438 aa, Streptococcus agalactiae
MAIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLDKCGR

SEQ ID NO: 14417 - protein, 235 aa, Sandersonia aurantiaca
MSGYLPFDEPNILALYKKIWKANFSFPSWFSSGAKKLIKRILDPNPHTRITIPEILEDEWFKKGYMPPHFQQGEEVNLDDIDAVFNDSKEHLVTEKKEKPESMNAFALISRSQVFDLGNLFEKQRGLIKRETRFTSQCPPNEILSKIEETAKPLGFNVRKHNYKMNLQGDKTGRKGHLSVATEVFEVAPSLHMVELRKTGGDTLEFHKFYKNFSSGLKDIVWKAEALPEQEETRS

SEQ ID NO: 14418 - protein, 475 aa, Anopterus macleayanus
  misc_feature (1)..(9): Xaa can be any naturally occurring amino acid
XXXXXXXXXSVGFKAGVKDYKLTYYTPDYETKDTDILAAFRVTPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 14419 - protein, 476 aa, Cuttsia viburnea
  misc_feature (1)..(9): Xaa can be any naturally occurring amino acid
  misc_feature (89)..(89): Xaa can be any naturally occurring amino acid
  misc_feature (94)..(94): Xaa can be any naturally occurring amino acid
  misc_feature (468)..(468): Xaa can be any naturally occurring amino acid
XXXXXXXXXSVGFKAGVKDYKLTYYTPDYETKDTDILAAFRVTPQPGVPPEEAGAAVAAESSTGTWTTVWTDGLTSLDRYKGRCYHIEXVPGEXNQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLASEGNEIIRGASKWSPELAAACEVWKEIKFXFQAMDTLD

SEQ ID NO: 14420 - protein, 170 aa, Fragaria x ananassa
MLVYQDLLSGDELLSDSFPYKEIQNGVLWEVDGKWVVQGAVDVDIGANPSAEGADADADEGVDDQTVKVVDIVDTFRLQEQPPFDKKQFVTWVKRYIKLLTPKLEGEQQETFKKNIEGATKFLLSKLSDLQFFVGESMGDDTSLVFASYKEGATDPIFIYFAHGLKEVKC

SEQ ID NO: 14421 - protein, 467 aa, Desulfovibrio gigas
MLPPAIASRWAAPNGYRDVLRISLPMIASMGAHTVMLTTDRFFLSQHSLEAIAASWPAGMANFAFMALFMGTAQYVNVFIAQYVGSEAPARVGAAVWQGVWFCLAAGLLMACTALLARPIFSLAGHEPMVLQMEVEYFQILSVGAIFGLLQNTLSCFYSGQGLTRPVMYVNIAGALVNVPLDYCFIFGVGPFPAWGVAGAAVATVIGAMVSAGLFALLVFSRENERRFGTRSQWRLDRELMRRFLRYGLPGGTQFGVEILAFTVFLFLAGRLGTEALAATNMAISINTVGFLPMVGLHIALSTMVGQAIGGGSPAMARRAIRSGLHLALLWTSFAVAVYVLLPEPLIAIFLDPDSPGAPAVLALGVELMRFVSAYAFFDALILVFFAALKGAGDTVFIMRSIIVVALGAMIIPGVAVVEWLDGNIYFLWSLLTAYVAILGVGGVLRYRGGKWQGMRVVETAAQVVDT

SEQ ID NO: 14422 - protein, 389 aa, Lactobacillus plantarum
MTMQHVFPTYQRFPFAITDGQGVHLTDNHGKTYLDFTAGIGVCNFGYHQPQIQAAVTQQLTHIWHTSNLYENELQDAVAGLLANGEERLVYFANSGTEANEAALKLARKYTGKTGILAFQHSFHGRTYGAMSMTGNPHIQAGYAPLVPGITFATYNDDAALDKITPELAAVILEVVQGEGGVFAGQTAWLQAVNAKCQATGVLLIIDEVQTGIGRTGYRMAYEGYGLDPDIYTVAKGLANGLPVGAMVGRRQLATAFGPGSHGSTFAGNAVAMAAAKRVLTQLTPALLTTVRAHAKLVWQSLATQVEPIPVVKQITGKGLMIGIHLDEQIPVNQVITRLQVEGLLTLSAGDNTLRLLPPIVMQPADLLAGIALIAKVLTTLTTEVTTNE

SEQ ID NO: 14423 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 14424 - protein, 255 aa, Pisum sativum
MSQYQNQYGAQTRKTDEYGNPVNQVDQYGNPISGGGGLTGEAGRQHYGTTGGATDHGHGHGQQHRGVDQTTGYGTHTGGVGGYGTKPEYGSTNTGSGYGTGTGYGGSGTTEYVREEHHGDKKGVMDKIKEKIPGTEQSRTNTDGTGYGSTGYGASGGGIGNTGQEYVREERHVHPGDKKHGSAGQEYVREEHHVHPGDKKHGSAGQEYVKEERRGIGNTGQEYVREEHRVDHGEKKGIMDKIKEKLPGTGGCTGH

SEQ ID NO: 14425 - protein, 198 aa, Pisum sativum
MSQYQNQYGAQTGMTDEYGNPVNQVDQYGNPVSGGGFTGEAGRQHFGTTGGVTGQGHGHGQQHRGVDQTTGYGTHTGGVGGYGTKPEYGSTNTGSGYGTGTGYGGSGSNEYVREEHHGDKKGVMDKIKEKIPGTEQSRTNTDGTGYGSTGQGYVREQQRVDHGDEQRVDHGDEQHGEKKGIMDKIKEKLPGTGACTGH

SEQ ID NO: 14426 - protein, 388 aa, Rhizopus microsporus
MKFTLISSCVAIATMALAVEAAPNGKKLSIPLAKNNDFKPNAKRSLLKALAKYNKTPKGDEISPQSTGSVPVVDVGSDLEYYGVVTVGTPGVQLKLDFDTGSSDLWFASTLCSTCSNSHTKYNPNKSSTYKADGRPWSISYGDGSSASGILAKDTVNLGGLAIKDQTIGLAKRESSAFAEDVIDGLLGLAFNSITTVRGVKTPMDNLISQGLISRPIFGVYLGKASNGGGGEYIFGGYDSTKFKGSFTTVPIDNSEGFWGVTVKGTKIGSKSIGGSFSAILDTGTTLLLLPDSVAASVARTYGASDNGDGTYTITCDSSKLQPLVFTLGSSTFQVPADSLIYEKSGSKCIAGFAAGGDLAILGDVFLKNNYVVFNQQVPEVQIAPIAQ

SEQ ID NO: 14427 - protein, 372 aa, Schizosaccharomyces pombe
DPIQEAAIPKSMVIRSGASEVGRSLSLLTRDLRHMMEPHTAIRLKERKANKIKDYLTMAGPLGVTHLLVLSRTDNNANLRIIRAPRGPSLHFRIHEYMLNKDVRRLQKNPKSPTTEFLTPPLLVMNHFNQNSSKDSPHEALLTTTFQNMFPPISVQHTNINSVKRVLLLNRRDDGYIDLRHFIISTKPVGISRPIRHLLKGEKKDSDIPDLHNVRDISDYVLHGDGISGAASDSEIEEDATVEIDRPVPTKTEENLLSASQLLKPKQQAIKLIEIGPRMTLELIKITEDAMGGKVLYHSHVHKSKEEIKQQDNFHEQSRALKEKRKKEQDENVRRKRENKKRRKDQKKEGITSSNKNDDSGNEGSSAYSDTE

SEQ ID NO: 14428 - protein, 487 aa, Skeletonema costatum
MSEVQSGQAEIKKYQTYALNVDPLQDDKATEIKLCNFSRPHMRAFHCSWFCFFTAFFIWFAIAPLMPEIKTTLGLTKQQIWTSNICSVAGTIFMRFVNGPICDKYGARIPMGFILVGASIPCAMTGLVTNAANLSVLRFFIGLGGSTFVMCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAEGSSYGIVPYINPPATGSIAGIVGAGGNTGAVAFGLGFRQLPYYDAFILMGSCIIASGVLSLFICIKGHAGLVTGQDSEEAIAAWKKLGSAPAATTLQVPEPDEDAAAEIEEDKA

SEQ ID NO: 14429 - protein, 445 aa, Thalassiosira weissflogii
KPHMRTFHCSWICFFTAFFIWFAIAPLLPEVKETLGLSKQQVWTSNICSVAGTIFMRFVNGPLCDKYGARILMGAMLFLASIPCALTGLVQNSAQLCVLRFFIGLGGSTFVMCQYWSSRMFTKEVAGTANAIVGGWGNLGGGVTQLIMGSVLFPLFKTGMSAEQAWRTVCIVPAVVGMTLGILVTKISDDAPKGNYSEMKKNGTMPEVSAAASFRTGTLNVNTWLLFIQYACCFGVELTMNNAAASYFKSTFELTTESAAAIASIFGWMNLFARGLGGFFSDKLNSKMGMRGRLIVQTICLVAEGVLVFVFANTPQLWAAILVMVFFSMFVQAAEGSTYGIVPYVNPPATGSIAGIVGAGGNTGAVCFGLGFRQLEAKPAFYLMGGCIVASGVLSLFICIKGHAGLVTGQDNPEVIAAYKKTAGAASATIQVPEPDAEAAEEMEK

SEQ ID NO: 14430 - protein, 280 aa, Thalassiosira weissflogii
PHSFPPHSVALQVLGTFILWFGWYGFNPGSTLGISGEGVPDVAALCAVTTTIAAASGSVSAMFTDMLPSRRSTGETMYDITMCMNGALSGLVGITAGCSVVEPWAAFVIGIVAGWTYIFWSALLVKLKIDDAVDAIPVHFGNGIWGCIAVGLFAEPTRTINAFGEHGHYGRFYSWGNGSADAHLLAAQVCGVLWIIGWVTVIMLPYFLILNAIGLFRVDALEEEVGLDISHHKGAAYDMSGPSADVQEKFEISRSQRKIRFPRRTLMKQPKQATLQLLDF

SEQ ID NO: 14431 - protein, 222 aa, Arabidopsis thaliana
STNFSGRSSRSSSSSSGFCSGNITEEENVDDDDDGCVDDWEAVADALAAEEEIEKKSRPLESVKEQVSVGQSASNVCDSSISDASDVVGVEDPKQECLRVSSRKQTSNRAWRLDDDLRPQGLPNLAKQLSFPELDKRFSSVAIPSSCPICYEDLDLTDSNFLPCPCGFRLCLFCHKTICDGDGRCPGCRKPYERNMVKAETSIQGGGLTIRLARSSSMFCKF

SEQ ID NO: 14432 - protein, 1054 aa, Stigmatella aurantiaca
MSKKRVHEIAKELKGHGIELDNKEVVTELAGLGYDVKSHSSSLDDDQATAAVQKILDKRKPKQAAAPVTAKGFVVRRKVGPPTGSGVYDASQEPSQAASDVSSPPSEPVHEASGAEAAASERVPEAAAVQEPVAEAPRAAASEPAAEAPKATAPVAPEPTVEAPKAAAPVAPEPTVEAPKTEAPVAAAPIAEAPTPPARTEVPVTSGRRAASCRGAAPLPCSGKDPLALNSSPQSSAAFCPDARNPGDCDFPSTSGRWHAWPSRGSSGRFAHGAGRPSGWTFARWTSGRPRAASRRTAVQRPSGRAGAGASHGLQRRKGFGAGAQASGQPQNVTMVGGIPHAPTAPDARALRPTATQAVVISRPLIQVRRVTPTTSSAKQYPMAPGKKAIGEVREFKVVPDHAGRGRELVDVSKNKDKSPRKRGGPNDTSISKQELTDLAWGRVNIPLRGKKKKPTKKGAKTQITQMAEDKKVIKLQEGISVSDLGQRMGVRTSDIIKKLMGLGKMATANQMVDADTVELIASDYGWKVDRVGFEVEDYLPEVVARPEDARTRPPVVTVMGHVDHGKTSLLDAIRAANVASGEAGGITQHIGAYSVTTARGDITFLDTPGHEAFTSMRARGANVTDIVILVVAADDGVMPQTIEAIKHAKAAEVPIVVALNKMDVPGANPDRVKKDLANHELVPEEWGGETIMVPVSAKQKMGIDLLLENVVLQAEVLELTSNPSRPAVGAIIEGELDRGRGPVATVLVQEGTLRVGDAVVTGTDYGRVRAMNNSRGESVKEVLPGYCAEVIGLSGVPSAGDTINVVADEKAAKQIAEHRGMKERQSELSKVSRETLDQLFAKTKAGGGPKELRVVIKADVQGSAEAVKQAVQKLTTHKVKVEVIDTGVGAITESDVMRAAASKGVVLGFNVKPESGAESAAKAEGVMLRSFSIIYELIDGVRSSMEELLEPIRTERKLGRAEVRNTFNVPKLGTIAGAAVLDGVIKRGAFVRLMRENKQLFAGKMASLRRFKDDVKEVAQGFECGIGIENFNDLKAGDIIEAYEIEETRQSLT

SEQ ID NO: 14433 - protein, 162 aa, Solanum commersonii
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 14434 - protein, 198 aa, Schizosaccharomyces pombe
MADARKNNVTIKVGMIGDSSIGKTSLMVTYVQGSFDEESTQTLGVNFMEKTISIRNTEITFSIWDLGGQREFVNMLPMVCNDAVAILFMFDLSRKSTLNSIKEWYRQARGFNKTAVPILIGTKYDHFMTFPREDQEEITKQARRYAKAMKASLVFCSTSHSINVQKIFKIVLAKVFDLKCTIPEIKNVGDPILEYIDR

SEQ ID NO: 14435 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 14436 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 14437 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 14438 - protein, 107 aa, Escherichia coli
AKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGR

SEQ ID NO: 14439 - protein, 447 aa, Enterococcus faecalis
  misc_feature (42)..(42): Xaa can be any naturally occurring amino acid
MKVIVLGSSHGGYEAVEELLNLHPDAEIQWYEKGDFISFLSXGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 14440 - protein, 342 aa, Candida albicans
QAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLLDSGTTITYLQQDLADQIIKAFNGKLTQDSNGNSFYEVDCNLSGDVVFNFSKNAKISVPASEFAASLQGDDGQPYDKCQLLFDVNDANILGDNFLRSAYIVYDLDDNEISLAQVKYTSASSISALT

SEQ ID NO: 14441 - protein, 310 aa, Vigna angularis
MENFPVINLENINGEERKAVLEKIEDACENWGFFELVNHGIPLELLDTVERLTKEHYRKCMEQRFKEAVASKGLEGVQGEIKDMDWESTFFLRHLPHSNISEIPDLSEEYRKAMKDFAQKLEKLAEELLDLLCENLGLEKGYLKKAFYGSKGPNFGTKVANYPPCPKPELVKGLRAHTDAGGIILLLQDDKVSGLQLLKDGQWVDVPPMRHSIVVNLGDQLEVITNGKYKSVEHRVIARTDGTRMSIASFYNPAGDAVIYPAPALLERKTQVIDKVYPKFVFEDYMRLYATLKFQPKEPRFEAMKGVNTV

SEQ ID NO: 14442 - protein, 456 aa, Perilla frutescens
MSLETVAAPPPATTVCVTGASGFIGSWIIMRLLERGYVVRATVRDPGDSKKVKHLIELPGADTNLTLWRADMNIEGSYDEAVQGCECVFHMATPMDFESDDPENEVIKPTVDGMLSIMRSCTKAKTVKKLIFTNSAGTLNVEEHQKPVYNEANWSDLDFIYSKKMTGWMYFVSKILAEKEAMKAAKESNINFISIIPPVVVGPFFMPTFPPSLITALSPITGNEAHYSIIKQGQFVHVDDLCEAHIFLFEHPAAEGRYICSSHDATIYDIAKMIGENWPEYHVPTEFEGIHKDIAVVSFSSKKLVDMGFSFKYTLEDMYRGAIESCREKGMLPFSTQIHTNGENKESLSNSQEKHSQINTNGENKDSILNSQINTNGENKDSILNSHDKHSQIHTNGENKESILNSQEKHSQIRTNGENKESIFNSLEKHDTDNNQEKELLPIPKEAHADRQEMQI

SEQ ID NO: 14443 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLATGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 14444 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINPERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 14445 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 14446 - protein, 321 aa, Zinnia elegans
VIKVICCGVCHTDLHQIKNDLGMSNYPMVPGHEVVGEVVEVGPDVTKFNVGDCVGVGCLVGCCNNCRPCNADVEQYCNKKIWTYNDVYTDGKPTQGGFAGSMVVHQKFVVKIPEGMAPEQVAPLLCAGVTVYSPLNHFGMKGSGLKGGILGLGGVGHMGVLIAKAMGHHVTVISSSDKKKEEALDVLGADDYLLSTDVERMQELADSFDYIIDTDPVHHPLEPSLSLLKLDGKLIIMGVINVPLQFVSPLLMLGRKTITEAFIGSMKETQEMLHFCKEKGVRSTIEVVKMDYINTAMERLAKNDVRYRFVVDVAGSNLHNE

SEQ ID NO: 14447 - protein, 451 aa, Alnus glutinosa
MTSLQYFSLNRPVFPATHLHRPGIRHLQVSACANVEVQAPSSVKKQGVSKEVMEAAGRVLVGTYARVPVVLSRGKGCKLYDPEGREYLDLSAGIAVNVLGHADSDWLRAVTEQAATLTHVSNVFYSIPQVELAKRLVASSFADRVFFSNSGTEANEAAIKFARKFQRFTRPDEKQPATEFVSFSNSFHGRTMGSLALTSKENYRSPFEPVMPGVTFLEYGNIEAATQLIQRRKIAAVFVEPIQGEGGVYSATKEFLYALRKACDDSGTLLVFDEVQCGLGRTGYLWAHEIYDVFPDIMTLAKPLAGGLPIGAVLVTERVASAITYGDHGTTFAGGPLVCKAALTVLDKILRPGFLASVSKKGHYFKEMLINKLGGNSHVREVRGVGLIVGIELDVSASPLVNACLNSGLLVLTAGKGNVVRIVPPLIITEQELEKAAEILLQCLPALDRHG

SEQ ID NO: 14448 - protein, 354 aa, Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 14449 - protein, 413 aa, Rhodobacter sphaeroides
MAKEPMLQFVKMARETPEKRPRSLRSQDFHEICGRICPQDRLCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDASGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 14450 - protein, 481 aa, Pseudomonas sp.
MFHVPLLIGGKPCSASDERTFERRSPLTGEVVSRVAAASLEDADAAVAAAQAAFPEWAALAPSERRARLLRAADLLEDRSSEFTAAASETGAAGNWYGFNVYLAAGMLREAAAMTTQIQGDVIPSNVPGSFAMAVRQPCGVVLGIAPWNAPVILGVRAVAMPLACGNTVVLKSSELSPFTHRLIGQVLHDAGLGDGVVNVISNAPQDAPAVVERLIANPAVRRVNFTGSTHVGRIIGELSARHLKPAVLELGGKAPFLVLDDADLDAAVEAAAFGAYFNQGQICMSTERLIVTAVADAFVEKLARKVATLRAGDPNDPQSVLGSLIDANAGQRIQVLVDDALAKGARQVVGGGLDGSIMQPMLLDQVTEEMRLYREESFGPVAVVLRGDGDEELLRLANDSEFGLSAAIFSRDVSRAMELAQRVDSGICHINGPTVHDEAQMPFGGVKSSGYGSFGSRASIEHFTQLRWLTIQNGPRHYPI

SEQ ID NO: 14451 - protein, 171 aa, Larix laricina
APSKTGNSNVVSAFTGLKSMAQFPSSKTMSNAGAEWERKTTSNGARVRCMQVWPPYANKKWETLSYLPRLTPEQLVKEVEYLLKNKWVPCLEFEEDGEIKRVYGNSPGYYDGRYWVMWKLPMFGCTEASQVLNEVNECAKAYPNAYIRVIGFDNVRQVQCISFIVHKPEYN

SEQ ID NO: 14452 - protein, 483 aa, Tortula ruralis
MTGEVKEYRLLLASKPVEADREFLDVTNKYTGEVGAKVQLATHDDVDKAIDAAVAAAPAMAALGAFERKAILEKTVAELKKRAEEIAQILTMESGKPIKDARGEVARTIDTFQVAAEESVRIYGEHMPLDISARNKGPQGIVKKFPIGPVSMVSPWNFPLNLVAHKVAPALAVGCPFVLKPASRTPLSALILGDILVPDRGAAKGAFSVLPVSRADADMFTVDERFKLLTFTGSGPVGWDMKARAGKKKVVMELGGNAPCIVDDYVPDLDYTIQRLINGGFYQGGQSCIHMQRLYVHERLYDEVKAEFLAQVKKLKVGNPFEDDTFIGPMISEKDATRVEDWVKEAVEKGGKLLCGGSRKGAVMQPTVLEDVPMDAMARKEEIFGPVVLFYKYSDFKEAVKECNNTHYGLQSGIFTKDLNKAFYAFEHMEVGGVILNDSPALRVDSQPYGGLKDSGIQREGVKYAMEDYLETKVLVMRNVGVL

SEQ ID NO: 14453 - protein, 342 aa, Vaccinium macrocarpon
MKDVNSGLGTTVCVTGAAGFIGSWLIMRLLERGYVVRATVRDPGNLKKVKHLLELPKADTNLTLWKADLNEEGSFDEAIEGCVGVFHVATPMDFESKDPENEVIKPTINGVLSIIKSCTKAKTVKRLVFTSSAGAVVDQEHQPLVFDENNWSDVDFLYDKKMTGWTYFVSKTLAERAAMEAAKEISIDFISIIPTLVVGPFISPTFPPSLITVLSPITGNEAHYSIIKQCQYVHLDDLCKYLMFLLEHPEAEGRYICSSHDATIYDLAKMMRRNGPGTMSPNEFKGIDKELPIMSFSSKKLLVIGFKFKYNLEDMFRGAIDTWQETKGLLPYSNATPNIGKN

SEQ ID NO: 14454 - protein, 354 aa, Vaccinium macrocarpon
MKDVNSGLGTTVCVTGAAGFIGSWLIMRLLERGYVVRATVRDPGNLKKVKHLLELPKADTNLTLWKADLNEEGSFDEAIEGCVGVFHVATPMDFESKDPENEVIKPTINGVLSIIKSCTKAKTVKRLVFTSSAGAVVDQEHQPLVFDENNWSDVDFLYDKKMTGWTYFVSKTLAERAAMEAAKEISIDFISIIPTLVVGPFISPTFPPSLITVLSPITGNDPHYSIIKQGQFVHLDDLCESHIYLFEHPEAEGRYICSSHDATIYDLAKIMRRNAPSTMSPTEFKGIPKDLPNVSFPSKKLIGMGFQFKYSLEDMFRGAIDTCQETKGLLPYSNETTANGNGNGNGNGNGNGTI

SEQ ID NO: 14455 - protein, 299 aa, Corynebacterium glutamicum ATCC 13032
MLLHPDAQFYIDTLPTLSAEEQVSFGKDAPVSEADATHVATDQDIAGVPVRVYTPLSGAGDLPCLVYFHGGGWSGGTLNMIDATVHSLVVGLPIIAISVDYRLAPAHPFPAAIDDAFAVVSAVLDGVSGLSIDTSRVAIGGDSAGGNIAAVTAQQLRERAVGSTPVLAHQVLIFPVTDVSTTSTPSYLTFGKDCYLTKDAMERYIEQYADGHDRTDPRLSPLLASDLSDLPPTTIVYGECDVLAHEVRAYGQALLEAGNSVTMTEFKGQIHAFINLGGISSDARAARRLIRAELEAALC

SEQ ID NO: 14456 - protein, 318 aa, Corynebacterium glutamicum ATCC 13032
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 14457 - protein, 326 aa, Corynebacterium glutamicum ATCC 13032
MTKTTRQTMQAIVQTEEKVTASLELQEVPVPTLKPGEVLVEVKAAGVNRADLLQTQGNYPVPAGASEILGLECAGVIVDAGDTGQTVGQEVACLLTGGGYAQYVAVPEGQLMPIPEGYSFVEAASIVEVACTVWSNIGMLAGLQKEDTFLIHGGAGGIGTFAIQMGKALGVTVAVTAGSTEKLKTCKNLGADILINYKEEDFAEVLKNKADVILDIIGAKYLSQNVKAMAKDAHMVVIGMQGGVKGELNLGHLLAKRGTISATALRGRDEADKARIVSSTVENIWPLLQSKEITPHIDHTLPLAEAAAALQKIQDGTITGKLVLAV

SEQ ID NO: 14458 - protein, 434 aa, Corynebacterium glutamicum ATCC 13032
MTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 14459 - protein, 453 aa, Corynebacterium glutamicum ATCC 13032
MVTFFAMAYIIILNPLILGTTPDVEGNTLGIAQVAAATALAAGVMTIAFGLIARYPFGIAAGLGINTMVAVTLVSGEGLTWPEAMGLVVLDGVVIVILAVSGFRVAVFRAIPASMKAAISVGIGLFIAMIGLVDAGFVRRIPDAAGTTVPVTLGIDGSIASWPTFVFVVGVLLCGILVVRRVRGGLFIGILGTTILAIIAEAIFDSGASFENGEANAEGWSLAVPGLPDSFGGIPDLSIVGAVDLIGAFSRIGVVAATLLIFTLVLANFFDAMGTMTALGKQGNLVDDEGNLPDIKKALVVEGAGAIVGGAFSASSNTVFADSSAGVADGARTGLANVVTGSLFLAAMFLTPLYEIVPIEAAAPVLVVVGAMMMGQVTEIDFSKFYIAFPAFLTIVIMPFTYSIANGIGVGFIMYAIMAAAAGKAKQVHWLMWLVAGLFVVFFAIDPIMEAVG

SEQ ID NO: 14460 - protein, 484 aa, Corynebacterium glutamicum ATCC 13032
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 14461 - protein, 250 aa, Corynebacterium glutamicum ATCC 13032
MTQTTESPMIKMTGVQKYFGDFHALTDIDLEIPRGQVVVVLGPSGSGKSTLCRTINRLETIEEGTIEIDGKVLPEEGKGLANLRADVGMVFQSFNLFPHLTIKDNVTLAPIKVRKMKKSEAEKLAMSLLERVGIANQADKYPAQLSGGQQQRVAIARALAMNPKIMLFDEPTSALDPEMVNEVLDVMASLAKEGMTMVCVTHEMGFARKAADRVLFMADGLIVEDTEPDSFFTNPKSDRAKDFLGKILAH

SEQ ID NO: 14462 - protein, 318 aa, Corynebacterium glutamicum ATCC 13032
MIGAPPDMGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 14463 - protein, 440 aa, Corynebacterium glutamicum ATCC 13032
MDTKLGAELGTEFDLIVVGFGKAGKTIAMKRSAAGDKVALIEQSPQMYGGTCINVGCIPTKKLLFETATGKDFPDAVVARDQLIGKLNAKNLAMATDKGVTVIDGKATFTASHEITVTSGSDTLVLYAPTIVINTGSTPVIPNVPGTDNPHVFDSTGIQHISPLPKHLAIIGGGPIGLEFATLFSGQGSKVTIIDRGELPLKNFDREVAELAKTDLEARGITFLNNAELTGFSGDLTIALKDHDLLADAALLAIGRRPATDGLGLEQAGIKTGTRGEVLVDAHLRTNIDGIFAVGDVNGGPQFTYVSYDDHRIVLDQLAGTGKKSTAHRLIPTTTFIEPPLSTIGDNTEGENVVVKKALIADMPIVPRPEIINQPHGMVKFFVDKQSDALLGATLYCADSQELINTVALAMRHGVTASELGDGIYTHPATSEIFNQLLGS

SEQ ID NO: 14464 - protein, 373 aa, Corynebacterium glutamicum ATCC 13032
MANVVLVDRMEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 14465 - protein, 368 aa, Thauera aromatica
MAAKSSVSSWRSEMSSNPHRWMMTSPGAPMVRAEFEIGELSADQVVVAVAGCGVCHTDLGYYYDSVRTNHALPLALGHEISGRVVQAGANAAQWLGRAVIVPAVMPCGTCELCTSGHGTICRDQVMPGNDIQGGFASHVVVPARGLCPVDEARLAAAGLQLADVSVVADAVTTPYQAVLQAGVEPGDVAVVIGVGGVGGYAVQIANAFGASVVAIDVDPAKLEMMSKHGAALTLNAREISGRDLKKAIEAHAKANGLRLTRWKIFECSGTGAGQTSAYGLLTHGATLAVVGFTMDKVEVRLSNLMAFHARALGNWGCLPEYYPAALDLVLDKKIDLASFIERHPLDQIGEVFAAAHAHKLTRRAILTP

SEQ ID NO: 14466 - protein, 317 aa, Schizosaccharomyces pombe
MQKDKFGPCAPSRIPLLSNDLISMLSGGVAATVSRTAVSPLERMKIIFQVQNNKEYTSLTSTLVKIWNREGLIGFFRGNGTNCLRAFPYGAVQFATFNMLKQRALKNRSHQNLENHERLLFGAIAGAASCATTYPLDIARTRLSIETAGLTSRSLAINNVANNSLKVKPLTLWSTLLYIVQHEGGYPALYNGLPATLLNVVPYVSICFFTFEFCKQKFFSNADLTAFQKLFLGGFTGIIGQTLTFPADVLRRRFQVNRIPGIGHNYKNIKSAIFHIYKTEGINGFFRGYSSNMLKIIPVMSITWYTYETVSKMLHDL

SEQ ID NO: 14467 - protein, 2218 aa, Stigmatella aurantiaca
MSSFLERVAELSPEKRAALAELLRLAPEPIAIVGMACRYPGGVKDSDSYWDLLKRGGDAVTEIPAARWDINAFYDPNQDSPGKTTTRWGGFLDDVEGFDPHLFGISPREAASMDPHQRLFLEVAWEALENAGQQTDRLAGSKTGVFVGLYTSDYSPVVLSDLNAINVYTGTGTANNVAAGRLSYLLDLQGPSFVVDTACSSSLVAVHLACQSLLNRECRMAVVGGVTLLLTPLTLVMASKMQLMAADGRCKTFDSRADGIAMGEGCGVVILKRLSDAQADGDRILAVIKASAINQDGRTNGLTAPSGASQQVLLRQALTRAGISPSQVTYVEAHGTGTPLGDPIEVEALAEVIGQPRPSGPPCVLGSVKANLGHTGAAAGVAGLIKVVLSMQNEAIPPQLHYRELNSNISLENTSLVIPKELHPWPAGKGPRIAGISAFGWSGTNAHVLVEEAPAAPKARAAVERPVHLLTLSARTEAALREFAERVKTYVSAHADLPIADLCYSANTGWSKFEHHLAVPAGTTAQLSERLSAFLEGQPQAGTSYGQVTGRRGPGVAFLFTGQGSQYAGMGRQLYQTQPTFRRALDRCDELLRPLLGRSILSVIYPEAGQASPIDETAFTQPALFAFEWALAELWRSWGVVPTVVMGHSVGEYVAACVAGVFTLEEGLALIVERARLMQSLPPGGEMAAVFTDGARTAQAIAPYASQVSIAAFNGPSETVISGDGKAVEAILGALSAEGVKVRRLGVSHAFHSPLMDPMLDAFERAAAKTRFMPPKITLISNLTGGPSEEFSARALRRHAREPVRFSDGMAALKARGVSVAVEIGPNATLLGIGSRCLPEGSVAWLPSLRKDKDEWEVLLATLGALSVRGVPVNWAGFDSDYPRRRVSLPNYPFQHERFALKQMDGRGVAPSGQVVGHPLLGSRLRVATVDGTLFESKFRADEPSFFSEHRVYGMSTVPATAYLEGALAAAEEIFGAGEHALESVDIQEALVLSDAPRTVQYLIGSREEGGTARFQVFSLASSGSGSEGVWTTHSSGQIRIASGAEPLSGTPLTPEQALEAIRTRCPRGLEPRAFYDWLEGQGLEYGPRFRGVQQVWRGDGEALGLVELPESAVDEAKAFKVHPGLMDACVQLFGVIEYREGAQDDTEVYLPVSIDRYRLKGRLGSKVWSHARIRPSEGTARETLKADIRLYDEAGRIVAEVEGMCIKRAPREMLARFGQAQFSNWLHEVEWKEEVRSAAAGAARPGSCRWVVFADRSGVAEALIDRLTARGEPVVRVLADDHYSREGDLVRLHPEQPEHVRSLMESAASSGGAVTRYLYLWGLDSSGPVSRGEASRVDTRAIGSNPLLHLVQELAGQQGSHQLFLVTRGAQATTREHAPIDAFQASLWGFARTIAFEHPELRPVRIDLEPSRKGGSPRETEILLGEVTRSDAASAEDAIAFRGSLRLVSRLMRQAKRASSNRKLRIPPAPAFRLEISQRGTLEDLTVRPVERRPPGPGEVEIRVRATGLNFRDVLNALGMYPGDPGLLGGECAGVISAIGPGVEGFKVGDPVVAVISLGSFATYCTVLADFVAHKPAALSFAQAAAIPIAFLTAQYGLQQLGRMAAGSRVLIHAAAGGVGMAAVQLAKRAGAEVFATASSGKWDVLEAMGVEHRMNSRTLDFADEVMARTEGQGIDIVLNSLADDFIPKSLSVLRSGGRFLEIGKRGVWTSAQVAERYPGVSYAIYDLGEVGTKDPSIIRSMFRALMAEFEQGTLVPPPLRVFALQDAVEAFRHMALAKHVGKVVITVNDGAPESAETTARAGAAVPIRGDSTYLITGGLSGLGLKTAQWMARRGARHLVLVARSEPGPEALGVIGELELSEVQVVVARGDVSRIDEVRGILDRVRDSLPPLRGIVHSAGVLDDGVLRQQTAGRFDRVLAPKAGGAWNLHLLTRDLPLDFFVLYSSIASMFGSASQGNYAAANAFLDALAHHRRALGLAGLSINWGAWSEAGMAARLSQRDMNRLSGQGIGTIAPDQGTQVLEMLLGQDAAQVGVLPIDWGTFFQRNPASKTSPFFSSLEGGTSVKKAAPTQVPSDILPRLREAAVGRREQLLSAHIREQAIKVLGLNPSHPLNPLQPLNEIGLDSLTAVELKNALGRTLGSSLHATLLFDYPTIDALTRYLAKEVMGWSAPALAPEAAEGAEDAEKARRVAEIQQLSDDEVAASINEELAALRQES

SEQ ID NO: 14468 - protein, 507 aa, Aspergillus fumigatus
MNSLKLLVVSPEINPSNRKARSIPVLNPFDRYGRVFFFSWLGFMVAFLSWYAFPPLLTVTIRKDLHMTQQQVANSNIVALLATFLVRFIAGPLCDRFGPRLVFIGLLLCGSIPTAMAGLVTTPNGLIALRFFVGILGGTFVPCQVWCTGFFDKNIVGTANSLAAGWGNAGGGITYFVMPAIYDSLVHSQGLAPHKAWRVAYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIADMLYKYTGAVWSKKVLLSFLGVVMGAFQLAIGLADPRSEATMFGLTAGLAFFLEACNGTNFAVVPHVHPFANGVVSGAVGGMGNLGGIIFAIIFRYNETHYSRSLWIIGVISIAANLAVSWIRPVPKSQMMRQ

SEQ ID NO: 14469 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 14470 - protein, 294 aa, Medicago sativa
MEQYEKVEKIGEGTYGVVYKARDRATNETIALKKIRLEQEDEGVPSTAIREISLLKEMQHRNIVRLQDVVHSEKRLYLVFEYLDLDLKKFMDSSPEFAKDQRQIKMFLYQILCGIAYCHSHRVLHRDLKPQNLLIDRSSNAVKLADFGLARAFGIPVRTFTHEVVTLWYRAPEILLGSRHYSTPVDVWSVGCIFAEMINQRPLFPGDSEIDELFKIFRITGTPNEETWPGVTSLPDFKSAFPKWPAKDLATQVPNLEPAGLDLLSSTCRLDPTRRITARGALEHEYFKDIKFVP

SEQ ID NO: 14471 - protein, 228 aa, Helianthus annuus
HLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPNEPPLDWPTRKRIALGSARGLSYLHDHCDPKIIHRDVKAANILLDEEFEAVVGDFGLAKLMDYKDTHVTTAVRGTIGHIAPEYLSTGKSSEKTDAFGYGIMLLELITGQRAFDLARL

SEQ ID NO: 14472 - protein, 228 aa, Helianthus annuus
HLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPNEPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARL

SEQ ID NO: 14473 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 14474 - protein, 396 aa, Fusobacterium nucleatum subsp. nucleatum ATCC 25586
MEKEYAEATELLYKGRKVKGMDFNKPEAFPLFTTTAFTMNSLTEVKKAYAEKYTYIRTCNPNRDALADMVTFLEAGEKSLIFSSGMGAITTTIMTILKPGDHVVCNRNIYGETFDVFTKLMPKFGISADLVDFDDIENCKKAIKAETKLIYSEVFANPTLNIADIPTLADIAHKNGALLMIDNTFSTPIAIKPIKFGADIVINSLTKFMNGHSDAIAGSITSTTEIIDAIHPVRMLCGTPGDPHAAHAMMKSFATMDLRLKKQMSNAAKLAAALEENKYVSKVNHPSLKSFSQHELALKLFTSNDTMSGMMSFIVPEDFEKIDKFMLRLNFAHYAMTLGGVRTTLVHPVTSSHSHMPDEARRAMGITPGLFRLSVGIEDVDDLIEDFNQALKVFGE

SEQ ID NO: 14475 - protein, 419 aa, Fusobacterium nucleatum subsp. nucleatum ATCC 25586
MAYFNIRFIILILLHGGRIMFKEFDETLSFETNILEAGAYFRLSTSNPEALPIHLTTAHNVEDLEDLQKRYDEKGFCYNRNRNPNRTALIELMNYVEGGEDSIGCSSGMAAISSSIIAHTKTGDHILSDKTLYGETLEIFTKILQKYGVETTFVDFTNIEEVKKNIKSNTVILYTETVSNPLIGVPNLKVLANIAHSNNAIFIVDNTFMTGALVQPLKFGADIVVNSLTKFANGHSDVVCGAATGKSELIKKIYELQVLLGTQSDPFSSWLTVRGMRTMELRIKKQCENASALALELEKSPYILKVNHPSLVNNPYHNLAHEQFGDYYGGMLSIELPEDLKKINKFMRTLKLAHYAMTLGGYRTSFAYPVMSSHSDMTRDERLAIGITDGLLRISVGIENIKDLINDFKNALEVAYGNK

SEQ ID NO: 14476 - protein, 434 aa, Fusobacterium nucleatum subsp. nucleatum ATCC 25586 [sequence omitted]

SEQ ID NO: 14477 - protein, 475 aa, Fusobacterium nucleatum subsp. nucleatum ATCC 25586
MRSLKKTKIVCTIGPVTESVETLKELLNRGMNVMRLNFSHGDYEEHGMRMKNFRQAMSETGIRGGILLDTKGPEIRTMTLKDGKDVSIKAGQKFTFTTDQSVVGDNERVAVTYENFAKDLKVGNMVLVDDGLLELDVVEIKGNEVICIARNNGDLGQKKGINLPNVSVNLPALSEKDIEDLKFGCQNNVDFVAASFIRKADDVRQVRKVLRENDGERIQIISKIESQEGLDNFDEILAESDGIMVARGDLGVEIPVEEVPCAQKMMIRKCNRVGKTVITATQMLDSMIKNPRPTRAEANDVANAILDGTDAVMLSGETAKGKYPLAAVEVMNKIAKKVDATIPPFYIEGVINKNDITSAVAEGSADISERLNAKLIVVGTESGRAARDMRRYFPRAHILAITNNEKTANQLVLSRGIISYVDASPKTLEEFFVVAESVAKKLNLVKNNDIIIATCGESVFIQGTTNSIKVIQVKA

SEQ ID NO: 14478 - protein, 254 aa, Fusobacterium nucleatum subsp. nucleatum ATCC 25586
MIYFLYKRRFYMSNMSLYIGEFVGTTLLLLLGNGVNMTCSLKHSYGKGGGWIVTTFGWGFAVMIPAYVTGWVSGAHMNPALTIALAVTGKFSWDLVFGYIIAQMLGGIFGATLAYLTYKAQMDAEPEPAVKLGVFSTGPSIDAPIWNIVTEIIGTALLLIGVLAIGYGEVGIQPGNGAFFVGLLIVIIGMATGGATGYAINPARDLGPRIAHAILPIKGKGDSNWKYSWIPVVGPIIGGILGAVIFDAFLSAVL

SEQ ID NO: 14479 - protein, 217 aa, Fusobacterium nucleatum subsp. nucleatum ATCC 25586
MEMDKNLVREVIAKRVAQEFHDGYVVNLGIGLPTLVANYVGDMDVIFQSENGCIGVGPAPEKGKEDPYLVNAGAGFITAAKGAMFFDSAYSFGIIRGGHVDATVLGALEVDEKGNLANWMIPGKKVPGMGGAMDLVVGAKKVIVAMEHTSNGAIKILKECKLPLTAVGVVDLIITEKAVFEVTDKGLVLKEITPYSSLEDIKATTAADFIIADDLKK

SEQ ID NO: 14480 - protein, 217 aa, Fusobacterium nucleatum subsp. nucleatum ATCC 25586
MKQKIVSMEEAISHVKDGMTVHIGGFIACGTPESIITALIEKGVKDLTIVANDTGLIDKGIGRLVVNNQVKKVIASHIGTNPETGRRMQSGEMEVELVPQGTLAERVRAAGYGLGGILTPTGLGTIVQEGKQIINVDGKDYLLEKPIKADVALIFGTKVDELGNVICEKTTKNFNPLMATAADVVIVEALEIVPAGSLSPEHLDISRIFIDYIVKSK

SEQ ID NO: 14481 - protein, 442 aa, Fusobacterium nucleatum subsp. nucleatum ATCC 25586
MKSNFETSLSKSLEKRFKFLDNGTNLKTELIAGLTTFATMSYVLATIPNMLEGAGLNRASILTALIIFIIICSIAMALYTNRPFALAPGLSSVAIIGTALPQMNMPVEVAFGLVFLSGLIFVIISFVGIREIVVKAIPASVKISISAGIGLYISLIGLKMAGVVVANPKNNTLNLGDMTTAKSILFVIGFLLILVLEARKIKGSLILAILIVTIIGIPMGVTKVPTNLINIPTGISDISFKIDILGALKPEYFPWIFTFFVPDFFGTMGIILGIANRAGWLDKDGNMQDIDRCFKVDSLSTVAGSFFCMPVMTTYLESASGVEDGGRTGMTALFTSFLFALTLLFTPIALMVPGVATAPVLTIIGFQMLSSMKSVNYNDKTESLPAFIAVAMTIFTFNIATGLSLSVLSYIILKVFSGKAKEIPKVMYGLALVLLYYLYTLI

SEQ ID NO: 14482 - protein, 199 aa, Fusobacterium nucleatum subsp. nucleatum ATCC 25586
MGNLKNHLMKYERRPIMKIYDFKVKNRKGEDISLENYKGKVLLIVNTATRCGFTPQYDELEALYSKYNKDGFEVLDFPCNQFGNQAPESNEEIHTFCQLNYKVKFDQFAKVEVNGENAIPLFKYLKEEKGFAGFDSKHKLTSVLTEMLSKNDPDFAKKSDIKWNFTKFLVDKSGNVVARFEPTTSAEVIEQEIKKLLEV

SEQ ID NO: 14483 - protein, 448 aa, Fusobacterium nucleatum subsp. nucleatum ATCC 25586
MKKINLDYSKVFNFISQDELNQIKVSIDKVAEKLHNKSGAGNNFLGWLDLPINYDKEEFSRIKKASEKIKADSDVLIVIGIGGSYLGARAVIECLSHSFFNSLNKEKRNAPEIYFAGQNISGRYLKDLIEIIGDRDFSVNIISKSGTTTEPAIAFRVFKELLENKYGEKAKDRIYVTTDKNKGALKKLADEKGYEKFVIPDDVGGRFSVLTAVGLLPIAVAGINIDALMNGAQIAREDYSKDFADNDCYKYAAIRNILYKKNYNIEILANYEPKFHYISEWWKQLYGESEGKDKKGIFPASVDLTTDLHSMGQYIQDGRRNLMETILNVENSDKDIVIKKEVEDLDGLNYLEGKGLSFVNNKAFEGTLLAHIDGGVPNLVINIPEVTAFNIGYLIYFFEKACAISGYLLEVNPFDQPGVESYKKNMFALLGKKGYEELSKELNERLKK

SEQ ID NO: 14484 - protein, 392 aa, Fusobacterium nucleatum subsp. nucleatum ATCC 25586
MAKRDYYEVLGIDKSASENDIKKAYRKAAMKYHPDKFANASDAEKKDAEEKFKEINEAYQILSDSQKKQQYDQFGHAAFEQGGAGFGGGFNAGGFDFGDIFGDIFGGGGFGGFEGFSGFGGSSRRSYVEPGNDLRYNLEITLEEAAKGVEKTIKYKRTGKCENCHGTGGEDDKMKTCPTCNGQGTIRTQQRTILGVMQSQSVCPDCHGTGKVPEKKCKHCHGTGTAKETVEKKVNVPAGIDDGQKLKYAGLGEASQNGGPNGDLYVVIRIKSHDIFVRDGENLYCEVPISYSTAVLGGEVEIPTLNGKKMIKVPEGTESGKLLKVKGEGIKSLRGYGQGDIIVKITIETPKKLTDKQKELLQKFEESLNEKNYEQKSSFMKKVKKFFKDIID

SEQ ID NO: 14485 - protein, 452 aa, Fusobacterium nucleatum subsp. nucleatum ATCC 25586
MAKGTVYYCSECGYKSVKWAGKCPQCGAWSSFEEVDELPKDVKKSKNSDIKVYEFKDVEYTSEDRYKTKYEEFDRLLGGGLLKGEVVLVTGNPGIGKSTLLLQVVNSYKDYGDVLYISGEESPTQIKNRGERLKISGEGIYIMAEMDILNIYEYVVSKKPKVVVVDSIQTLYNSSMDSISGTPTQIRECTLKIIEMAKKYNISFFIVGHITKDGKVAGPKLLEHMVDAVFNFEGDEGLYYRILRSVKNRFGSTNEIAVFSMEENGMREIKNSSEYFLSEREEKNIGSMVVPILEGTKVFLLEVQSLITDSGVGIPKRVVQGYDRNRIQILTAIAEKKLYVPLGMKDLFVNVPGGLAIEDPAADLAVLMSILSVHKGFAISQKIAAIGELGLRGEIRKVFFLERRLKELEKLGFTGVYVPESNRKEIEKKKYKLKIIYLKNLDELLERMNKND

SEQ ID NO: 14486 - protein, 421 aa, Fusobacterium nucleatum subsp. nucleatum ATCC 25586
MNIKYDLVIVGGGPAGLAAAVEARKNRIDNILVIERAKELGGILQQCIHNGFGLHEFKEELTGPEYAQRFMDQLFELNIEYKLDTMVLGISENKIVQAINSVDGYMIIQAKSVILTMGCRERTRGAIAIPGDRPAGIFTAGAAQRYINMEGYMVGKRVVILGSGDIGLIMARRLTLEGAKVLAVAELMPFSGGLTRNIVQCLDDYDIPLYLSHTVVDIIGKDRVEKVIIAKVDENKKAIHGTEIEYECDTLLLSVGLIPENDISRATGIKIDPRTNGPIVNELMETSIVGIFASGNVVHVHDLVDFVSIESRKAGKSAAKYIKGEVADGEYIEVQTGNGIGYTVPQKFRIENIEKNLELSMRVRQIYKNVKIVVKSNDFVIYSVKKNHMAPGEMEKITLSKTILGKIDANKIVVEVVEEDK

SEQ ID NO: 14487 - protein, 239 aa, Fusobacterium nucleatum subsp. nucleatum ATCC 25586
MLSKVVTKEEALSKFCDGQTIMFSDWHGEFAADDLIDGVLEKGVKDIKAIAVSAGMPDLGVGKLIEAKRVKSLITTHIAFNPCAKEQMFAGELDVEFSPQGTFSERIRCGGFGLGGCLTPTGLGTEVEEGKQKFNINGKEYLLELPLRADIALIKATKADTAGNLYFRMTSGAIADSMAFAADTVIVEVEELVELGELGPEEVHVPAPIVDMVYVRTGQKRHTCPLWQRLRAKAEGRDK

SEQ ID NO: 14488 - protein, 175 aa, Fusobacterium nucleatum subsp. nucleatum ATCC 25586
MNYRIENLIDKEAVEKRIKELAREIEKDYAGEEVYCVGLLKGSVIFLSDLVKEINIPVIIDFMSVSSYGSETVSSGDVKILKDTDLDLRGKHVLIVEDIIDTGLTLEYVIKYFKEGKGVKSLRTCTLLNKPERRKVDVKVDYIGFDVPDKFVIGYGLDYDQKYRNLPYIAVVIPE

SEQ ID NO: 14489 - protein, 501 aa, Fusobacterium nucleatum subsp. nucleatum ATCC 25586
MNNDFILTEFARVINSDRYQYTESDIFLMENMQNKVAVFDMFFRKTEDGGFAVVSGVQEVIHLIEVLNTTSEEEKKKYFSKILEEEHLINFLSKMKFTGDLYAIQDGEIVYPNEPVITIKAPLIQAKILETPILNIMNMNMAISTKASMVTRAAEPIKVLAFGSRRAHGFDSAVEGNKAAIIGGCYGHSNLVTEYKYGIPSNGTMSHSYIQAFGVGAEAEKEAFVTFIKHRRQRKNNSLILLVDTYDTIHIGIENAIKAFKECGINDSYEGVYGVRLDSGDLAYQSKKCRKRFDEEGFTKAKITLTNSLDEQLIRSLREQGACVDMYGVGDAIAVSKSYPCFGGVYKIVELDEEPLIKISGDVIKISNPGFKEVYRIFDKEGFAYADLISLVKNDSDKEKLLNNDELMIRDEKYEFKNSILKKDEYTYKKLTKIYIKDGIIDRTSYEDLFDITKSQKHYFDSLAKISPERKRLENPHSYKVDLSSDLINLKYSLINKIKNV

SEQ ID NO: 14490 - protein, 304 aa, Fusobacterium nucleatum subsp. nucleatum ATCC 25586
MSILKNLAKNLGLTNITQPKKKYATVGEKKSDEEKERAKYKVKNIDNLKEDEVTKCPSCGVLSHKSEIRANMKMCSNCNHYFNMSARERIELLIDEGTFKEEDVTLTSANPINFPEYVEKIEKAQHDSGMNEGVISGLGEINGLKVSIACMDFNFMGGSMGSVVGEKITAALERAIEHKIPAVVVAISGGARMQEGLTSLMQMAKTSAAVKKMRLAGLPFISVPVNPTTGGVTASFAMLGDIIISEPKARIGFAGPRVIEQTIRQKLPENFQKSEFLQECGMVDVIAKREDLKATIFKVLNDII

SEQ ID NO: 14491 - protein, 491 aa, Fusobacterium nucleatum subsp. nucleatum ATCC 25586
MENILKKSYKMFINGEWIDSSNGVMVKSYAPYNNELLSEFPDASESDIDFAIKSAKEAFKTWRKTTVKERARILNKIADIIDENKDLLATVETMDNGKPIRETKLVDIPLAATHFRYFAGCILADEGQATVLDEKFLSLILREPIGVVGQIIPWNFPFLMAAWKLAPALAAGDTVVLKPSSTTTLSLLVLMELIQDVIPKGVVNLVTGKGSTAGEFLKNHPDLDKLAFTGSTAVGRDIALAAAEKLIPATLELGGKSANIILDDADIEKALEGAQLGILFNQGQVCCAGSRIFVQEGIYDEFISKLVKKFENIKIGNPLDPTTIMGSQIDARQVKTILDYVEIAKQEGGVILTGGVKYTENGCDKGNFVRPTLITNVNNGCRVSQEEIFGPVAVVIKFKTDDEVIAQANDSEYGLGGAVFTKNINRALKLAREIQTGRVWINTYNQIPEHAPFGGYKKSGIGRETHKVILEHYTQMKNILIDLEEGTSGLY

SEQ ID NO: 14492 - protein, 338 aa, Fusobacterium nucleatum subsp. nucleatum ATCC 25586
MKVLFYGVREVEIPLFHELNKKEGFGYELELIPDYLNSKETAEKAKGFECVVLRGNCFATKEVLDMYKEYGVKYLLTRTVGTNHIDVKYAKELGFKLAYVPFYSPNAIAELAVSLAMSLLRHLPYTAEKFKNRNFTVDAQMFSKEVRNCTVGVIGLGRIGFTAAKLFKGLGANVIGYDMFPKTGVEDIVTQVPMDELIKKSDIITLHAPFIKENGKIVTKEFLNNMKENSILINTARGELMDLEAVIEALESGHLAAAGIDTIEGEVNYFFKNFSDKQAEFRADYPLYNRLLDLYPRVLVTPHVGSYTDEAASNMIETSFENLKEYLDTGACKNDIKA

SEQ ID NO: 14493 - protein, 453 aa, Fusobacterium nucleatum subsp. nucleatum ATCC 25586
MKFWSIVLLTINSIIGTGIFLSPGAVAKLVGDKAATIYLAAAVFAAVLAVTFAAASKYVVKSGAAYAYSKAAFGDEVGSYVGITRVVSASIAWGVMATGVVKTTLSIFGQDSSNVKNVTIGFITLMFVLLIINLIGTKLLTLISNISTIGKIGALGITIIAGIFILVFSDGANLQGLTLLKDAEGNNLIPEFTTSVFVTALVGAFYAFTGFESVASGSADMEKPEKNLPRAIPLAIAIIAAIYFGIVFVSMYIDPVAMVTSKDPVVLASVFKNQLLQKIIVMGALMSMFGINVAASFHTPRVFEAMAKEKQVPDFFAKRTKSGLPLTSFILTAIIAVVIPLAFNYNMAGIIIISSISRFIQFIVVPVAVIVFFYGKSKEEILNTNKNFIIDVIIPIIALLLTILLLVKFNWAQQFSTKLDDGTVTVNLKAVVSMVIGYLILPIVLRIYMRTKK

SEQ ID NO: 14494 - protein, 335 aa, Fusobacterium nucleatum subsp. nucleatum ATCC 25586
MQKTKIIFFDIKDYDKEFFKKYGADYNFEMTFLKVRLTEETANLTKGYDVVCGFANDNINKETIDIMAENGIKLLAMRCAGFNNVSLKDVNERFKVVRVPAYSPHAIAEYTVGLILAVNRKINKAYVRTREGNFSINGLMGIDLYEKTAGIIGTGKIGQILIKILRGFDMKVIAYDLFPNQKVADELGFEYVSLDELYANSDIISLNCPLTKDTKYMINRRSMLKMKDGVILVNTGRGMLIDSADLVEALKDKKIGAVALDVYEEEENYFFEDKSTQVIEDDILGRLLSFYNVLITSHQAYFTKEAVGAITVTTLNNIKDFVEGRPLVNEVPQNQ

SEQ ID NO: 14495 - protein, 434 aa, Fusobacterium nucleatum subsp. nucleatum ATCC 25586
MVFKNSIDLYKKAVELIPGGVNSPVRAFKSVNREAPIFIKKGQGAKIWDEDDNEYIDYICSWGPLILGHNHPKVIEEVKKIIENGSSYGLPTKYEVDLAELIVDIVPSIEKVRLTTSGTEATMSAVRLARAYTQRNKILKFEGCYHGHSDALLVKSGSGLLTEGYQDSNGITDGVLKDTLTLPFGDIEKVKEILKNKDVACVIVEPIPANMGLIETHKEFLQGLGKVTEKTGTILIFDEVISGFRLALGGAQEFFGITPDLTTLGKIIGGGYPVGAFGGKKEIMDLVAPVGRVYHAGTLSGNPIASKAGFATISYLKENPNIYKELEEKTNYLIDNIEILAKKYSVNVCVNSMGSLFTIFFVDIDKVENLEDSLKSNTENFSIYFNTMLENGIVIPPSQFEAHFLSMAHTKKELNRTLEVIEMAFKKIGEKSGK

SEQ ID NO: 14496 - protein, 398 aa, Fusobacterium nucleatum subsp. nucleatum ATCC 25586
MKKIITDLDLNNKKVLMRVDFNVPMKDGKITDENRIVQALPTIKYVLEHNAKLILFSHLGKVKIEEDKATKSLKAVAEKLSELLGKNVTFIPETRGEKLESAINNLKSGEVLMFENTRFEDLDGKKESKNDSELGKYWASLGDVFVNDAFGTAHRAHASNVGIAENIGNGNSAVGFLVEKELKFIGEAVNNPKRPLIAILGGAKVSDKIGVIENLLTKADKILIGGAMMFTFLKAEGKNIGTSLVEDDKLDLAKDLLAKSNGKIVLPVDTVIASEFKNDIEFSTVDVDNIPNNKMGLDIGEKTVTLFDSYIKTAKTVVWNGPMGVFEMSNFAKGTIGVCESIANLTDAVTIIGGGDSAAAAISLGYADKFTHISTGGGASLEFLEGKVLPGVEAISNK

SEQ ID NO: 14497 - protein, 215 aa, Fusobacterium nucleatum subsp. nucleatum ATCC 25586
MTNGIKIAPSILSSDFSKLGEEVAAIDKAGADYVHIDVMDGQFVPNLTFGPPVIKCIRKCTGLIFDVHLMIDKPERYIEDFVKAGADIVVVHAESTIHLHRVIQQIKSFGIKAGISLNPSTPEEVLKYVINDIDMVLVMSVNPGFGGQKFIPAVVEKIKAIKKMRVDIDIEVDGGITDETIKVCVDAGANIFVAGSYVFSGNYKERIDLLKLKAK

SEQ ID NO: 14498 - protein, 228 aa, Fusobacterium nucleatum subsp. nucleatum ATCC 25586
MKLVLIRHGESAWNLENRFTGWKDVDLSPKGMEEAKSAGKILKEMNLVFDVAYTSYLKRAIKTLNIVLEEMDELYIPVYKSWRLNERHYGALQGLNKAETAKKYGDEQVHIWRRSFDVAPPSIDKNSEYYPKSDRRYADLADSDIPLGESLKDTIARVLPYWHSDISKSLQEEKNVIVAAHGNSLRALIKYLLNISNEDILNLNLVTGKPMVFEIDKDLKVLSSPELF

SEQ ID NO: 14499 - protein, 242 aa, Fusobacterium nucleatum subsp. nucleatum ATCC 25586
MINVENLSKNFGNLKVLKNISTTINKGEIISIIGPSGSGKSTFLRCINKLEEPTKGHIYIDGMDLMDKNTDMNKIRERVGMVFQHFNLFPNMTVLENLTLSPIMVKKESKEEAEKYASYLLEKVGLSDKANSYPSQLSGGQKQRIAIARALAMKPEVILFDEPTSALDPEMIKEVLDVMRDLAKEGMTMIIVTHEMGFAKNVGNRILFMDNGEIIEDCSPKDFFENPTNERIKDFLNKVLNK

SEQ ID NO: 14500 - protein, 459 aa, Fusobacterium nucleatum subsp. nucleatum ATCC 25586
MEKIYDLLVIGWGKAGKTLSAKLGAKGKKVAIIEENPKMYGGTCINVGCLPTKSLVHSAKILAEVKKYGIDGDYSFKNNFFKEAMKKKEEMTIKLRNKNFGLLDTNENVDIYNGRASFVSNNEVKITSSDNKEIVLKADKIVINTGSVSRTLNTEGIDNKNVMTSEGILELKKLPKKLLIIGAGYIGLEFASYFSNFGSEVSVFQFDDAFLAREDEDETKIIKEILENKGVKFFFNTSVKKFEDLGDSVKAICMKDGQEFSEEFNKVLVAVGRKPNTDNLGLENTSIQLGKFGEILVDDYLKTNAPNIWAVGDVKGGAQFTYVSLDDFRIVFPQILGENNRRKLSDRVLIPTSTFIDPPYSRVGINEKEAQRLGINYTKKFALTNTIPKAHVINEIDGFTKILINENDEIIGASICHYESHEMINLLALAINQKIKSKVLKDFIYTHPIFTESLNDILG

SEQ ID NO: 14501 - protein, 220 aa, Fusobacterium nucleatum subsp. nucleatum ATCC 25586
MIITVDKINKTYKNGSLELQVLKNISFKVDKGEFLAIMGSSGSGKSTMMNILGCLDNQYEGRYILDGIDISKSTENELSEIRNKKIGFIFQSFNLLPRLTALENVELPLVYSSIPKEERHKRANELLEMVGLKDRTHHRPNELSGGQRQRVAIARALVNNPSIILADEPTGNLDSKSEEEIIEILQKLNKMGKTIVIVTHEPSIGEIAERKIIFKDGEII
